US009260691B2

(12) United States Patent
Youil et al.

(10) Patent No.: US 9,260,691 B2
(45) Date of Patent: Feb. 16, 2016

(54) METHODS RELATING TO AN ATTENUATED MYCOPLASMA

(75) Inventors: Rima Youil, Port Melbourne (AU); Youssef Abs El-Osta, Glenroy (AU)

(73) Assignee: BIOPROPERTIES PTY LTD, Ringwood, Victoria (AU)

( * ) Notice: Subject to any disclaimer, the term of this patent is extended or adjusted under 35 U.S.C. 154(b) by 0 days.

(21) Appl. No.: 13/697,714

(22) PCT Filed: May 19, 2011

(86) PCT No.: PCT/AU2011/000584

§ 371 (c)(1), (2), (4) Date: Mar. 27, 2013

(87) PCT Pub. No.: WO2011/143706

PCT Pub. Date: Nov. 24, 2011

(65) Prior Publication Data

US 2013/0243819 A1 Sep. 19, 2013

(30) Foreign Application Priority Data

May 19, 2010 (AU) ................................ 2010902198

(51) Int. Cl.

| | |
|---|---|
| ***A61K 39/04*** | (2006.01) |
| ***C07K 14/35*** | (2006.01) |
| ***C12N 15/00*** | (2006.01) |
| ***C12Q 1/00*** | (2006.01) |
| ***C12N 1/36*** | (2006.01) |
| ***A61K 39/02*** | (2006.01) |
| ***C07K 14/30*** | (2006.01) |
| ***C12Q 1/68*** | (2006.01) |
| *A61K 39/00* | (2006.01) |

(52) U.S. Cl.

CPC .............. *C12N 1/36* (2013.01); *A61K 39/0241* (2013.01); *C07K 14/30* (2013.01); *C12Q 1/689* (2013.01); *A61K 2039/522* (2013.01); *C12Q 2600/156* (2013.01)

(58) Field of Classification Search

None

See application file for complete search history.

(56) References Cited

U.S. PATENT DOCUMENTS

| | | | | |
|---|---|---|---|---|
| 6,585,981 | B1 | 7/2003 | Pijoan | |
| 2009/0117152 | A1 * | 5/2009 | Chu et al. | 424/201.1 |

FOREIGN PATENT DOCUMENTS

| | | | |
|---|---|---|---|
| CN | 101420975 | A | 4/2009 |
| WO | WO 00/18434 | | 4/2000 |
| WO | WO 02/10343 | | 2/2002 |
| WO | WO2009/035644 | A1 | 3/2009 |
| WO | WO2009/036241 | A1 | 3/2009 |
| WO | WO 2010/094064 | | 8/2010 |
| WO | WO 2010/132932 | | 11/2010 |

OTHER PUBLICATIONS

Pagani et al. 2004 (Genomic variants in exons and introns: identifying the splicing spoilers; Nature Reviews 5:389-396).* de Castro et al. 2006 (Variable number of tandem amino acid repeats in adhesion-related CDS products in Mycoplasma hyopneumoniae strains; Veterinary Microbiology 116:258-269).*

Bauman et al. 2011 (Chapter 17: Immunization and Immune Testing; in Microbiology with Diseases by Body System; published by Benjamin Cummings, ISBN-13: 9780321712714, pp. 490-509).*

English Translation of Chinese Examination Report received in Application No. 201180024822.8 dated Apr. 25, 2014.

Deli, et al., "A Study on Clinical Application of Polymerase Chain Reaction in Detection of Mycoplasma Pneumoniaex," *Chinese Journal of Pediatrics,* 32(5):296-297 (1994).

Minguang, et al., "Detection and Analysis of Trachomatis and Mycoplasm in the Patients with Non-Bacterial Prostatitis," *Zhejiang Journal of Preventive Medicine,* 15(2):9-10 (2003).

European Search Report received in Application No. 11782772.5—1410/2571980 dated Jan. 29, 2014.

N.F. Friss, "Some Recommendations Concerning Primary Isolation of Mycoplasma suipneumoniae and Mycoplasma flocculare—A Survey", From the State Veterinary Serum Laboratory, Copenhagen, Nor. Vet-Med., 1975, 27, pp. 337-339.

Lloyd & Etheridge, "The Pathological and Serological Response Induced in Pigs by Parenteral Inoculation of *Mycoplasma Hyopneumoniae*", (1981) J. Comp. Path. 91:77-83.

Nonamura and Imada, "Temperature—Sensitive Mutant of Mycoplasma synoviae" (1982) Avian Diseases, vol. 26, No. 4 (Oct.-Dec. 1982), pp. 763-775.

De Castro et al., "Variable number of tandem amino acid repeats in adhesion-related CDS products in *Mycoplasma hyopneumoniae* strains", Veterinary microbiology, 2006, vol. 116, No. 4, pp. 258-269.

Ferreira and de Castro "A preliminary survey of *M. hyopneumoniae* virulence factors based on comparative genomic analysis", Genetics and Molecular Biology, 30, 1, pp. 245-255, (2007).

Madsen, M.L. et al., Array-Based Genomic Comparative Hybridization Analysis of Field Strains of *Mycoplasma hyopneumoniae,* Journal of Bacteriology, Nov. 2007, vol. 189, No. 22, pp. 7977-7982.

Szczepanek et al., "Comparative Genomic Analyses of Attenuated Strains of *Mycoplasma gallisepticum*", Infection and Immunity, Apr. 2010, vol. 78, No. 4, pp. 1760-1771.

PCT/AU2011/000584 International Search Report dated Jul. 21, 2011 (7 pages).

PCT/AU2011/000584 International Preliminary Report on Patentability dated Aug. 24, 2012 (15 pages).

* cited by examiner

*Primary Examiner* — Gary Nickol

*Assistant Examiner* — Mary Lyons

(74) *Attorney, Agent, or Firm* — Brinks Gilson & Lione

(57) ABSTRACT

The present invention provides a method for identifying or generating an attenuated *mycoplasma* bacterium, which bacterium comprises a mutation in at least one gene as listed and use of the bacterium in a vaccine for eliciting protective immunity against *mycoplasma* or for detecting infection by said bacterium.

5 Claims, 18 Drawing Sheets

Figure 1A - 1

| Number | | | | Nucleotide Base | | | | Gene | Nature of mutation |
|---|---|---|---|---|---|---|---|---|---|
| J | LKR | MTR | P12 | J | LKR | MTR | P12 | | |
| 3075 | 3072 | 3072 | 3074 | A | A | Δ A | Δ A | GidA gene [tRNA uridine 5-carboxymethylaminomethyl modification enzyme YP_278808.1 | Frameshift |
| 7324 | 7316 | 7311 | 7318 | A | A | Δ A | Δ A | Hypothetical protein YP_278812.1 | Frameshift |
| 17143 | 17119 | 17111 | 17126 | T | T | Δ T | Δ T | Intergenic | |
| 19386 | 19361 | 19350 | 19367 | T | T | Δ T | Δ T | Putative ABC transporter ATP binding YP_278823.1 | Frameshift |
| 31773 | 31738 | 31723 | 31754 | T | T | Δ T | Δ T | Isoleucyl tRNA synthetase YP_278833.1 | Frameshift |
| 48566 | 48512 | 48490 | 48597 | A | A | Δ A | Δ A | GTPase ObgE YP_278842.1 | Frameshift |
| 48881 | 48827 | 48804 | 48852 | A | A | Δ A | Δ A | Intergenic | |
| 51166 | 51112 | 51083 | 51136 | A | A | Δ A | Δ A | DNA polymerase IV YP_278846.1 | Frameshift |
| 59567 | 59498 | 59468 | 59529 | T | T | Δ T | Δ T | Intergenic | |
| 66347 | 66274 | 66236 | 66302 | A | A | Δ A | Δ A | Intergenic | |
| 75037 | 74954 | 74906 | 74985 | A | A | Δ A | Δ A | Hypothetical protein YP_278865.1 | Frameshift |
| 79461 | 79377 | 79326 | 79407 | T | T | Δ T | Δ T | Excinuclease ABC subunit C YP_278867.1 | Frameshift |
| 86810 | 86721 | 86667 | 86749 | T | T | Δ T | Δ T | Hypothetical protein YP_278873.1 | Frameshift |
| 89715 | 89626 | 89570 | 89653 | A | A | Δ A | Δ A | Intergenic | |
| 94740 | 94647 | 94587 | 94671 | A | A | Δ A | Δ A | Intergenic | |
| 94742 | 94649 | 94589 | 94673 | T | T | Δ T | Δ T | Intergenic | |
| 104392 | 104281 | 104212 | 104297 | T | T | Δ T | Δ T | Intergenic | |
| 104393 | 104282 | 104213 | 104298 | A | A | Δ A | Δ A | Intergenic | |
| 117390 | 117262 | 117188 | 117282 | A | A | Δ A | Δ A | Intergenic | |
| 118681 | 118553 | 118478 | 118572 | A | A | Δ A | Δ A | Hypothetical protein YP_278896.1 | Frameshift |
| 118716 | 118588 | 118512 | 118606 | A | A | Δ A | Δ A | Hypothetical protein YP_278896.1 | Frameshift |
| 120943 | 120810 | 120729 | 120827 | A | A | Δ A | Δ A | Intergenic | |
| 125147 | 125010 | 124925 | 125028 | A | A | Δ A | Δ A | Putative outer membrane protein P95 YP_278901.1 | Frameshift |
| 131715 | 131576 | 131486 | 131595 | A | A | Δ A | Δ A | Triosephosphate isomerase YP_278904.1 | Frameshift |
| 133772 | 133626 | 133537 | 133645 | T | T | Δ T | Δ T | Intergenic | |
| 136750 | 136600 | 136511 | 136620 | T | T | Δ T | Δ T | Hypothetical protein YP_278906.1 | Frameshift |
| 143404 | 143252 | 143156 | 143272 | T | T | Δ T | Δ T | Intergenic | |
| 143493 | 143339 | 143243 | 143359 | A | A | Δ A | Δ A | Intergenic | |
| 147361 | 147194 | 147100 | 147214 | A | A | Δ A | Δ A | Intergenic | |
| 153557 | 153372 | 153282 | 153379 | T | T | Δ T | Δ T | Intergenic | |

Amended

Figure 1A - 2

| Number | | | | Nucleotide Base | | | | Gene | Nature of mutation |
|---|---|---|---|---|---|---|---|---|---|
| J | LKR | MTR | P12 | J | LKR | MTR | P12 | | |
| 155557 | 155366 | 155275 | 155373 | A | A | Δ A | Δ A | Hypothetical protein YP_278917.1 | Frameshift |
| 157051 | 156860 | 156767 | 156866 | A | A | Δ A | Δ A | Hypothetical protein YP_278919.1 | Frameshift |
| 163824 | 163618 | 163519 | 163631 | A | A | Δ A | Δ A | Uracil-DNA glycosylase YP_278929.1 | Frameshift |
| 170370 | 170152 | 170050 | 170169 | T | T | Δ T | Δ T | Intergenic | |
| 178555 | 178332 | 178222 | 178349 | T | T | Δ T | Δ T | Putative chromate transport protein YP_278943.1 | Frameshift |
| 183981 | 183755 | 183643 | 183771 | T | T | Δ T | Δ T | Hypothetical protein YP_278948.1 | Frameshift |
| 187424 | 187191 | 187078 | 187208 | A | A | Δ A | Δ A | Intergenic | |
| 187449 | 187216 | 187103 | 187233 | A | A | Δ A | Δ A | Intergenic | |
| 190701 | 190467 | 190352 | 190484 | A | A | Δ A | Δ A | Putative ABC transporter ATP binding and permease protein YP_278958.1 | Frameshift |
| 212677 | 212420 | 212297 | 212445 | T | T | Δ T | Δ T | 50S Ribosomal protein L3 YP_278992.1 | |
| 214047 | 213787 | 213658 | 213817 | A | A | Δ A | Δ A | Hypothetical protein YP_278995.1 | Frameshift |
| 214362 | 214096 | 213969 | 214129 | A | A | Δ A | Δ A | Intergenic | |
| 226284 | 226068 | 225865 | 226047 | T | T | Δ T | Δ T | Hypothetical protein YP_279003.1 | Frameshift |
| 234616 | 234334 | 234188 | 234371 | A | A | Δ A | Δ A | Hypothetical protein YP_279009.1 | Frameshift |
| 235499 | 235215 | 235066 | 235251 | T | T | Δ T | Δ T | Intergenic | |
| 246806 | 246518 | 246360 | 246550 | A | A | Δ A | Δ A | Intergenic or putative lipoprotein YP_279015.1 | |
| 246808 | 246520 | 246362 | 246552 | A | A | Δ A | Δ A | Putative lipoprotein YP_279015.1 | Frameshift |
| 252401 | 252109 | 251949 | 252141 | T | T | Δ T | Δ T | Ribonucleotide-disulphate reductase subunit alpha YP_279017.1 | Frameshift |
| 271614 | 271294 | 271122 | 271333 | T | T | Δ T | Δ T | Hypothetical protein YP_279032.2 | Frameshift |
| 293668 | 293332 | 293149 | 293374 | A | A | Δ A | Δ A | Hypothetical protein YP_279046.1 | Frameshift |
| 300092 | 299752 | 299563 | 299795 | A | A | Δ A | Δ A | Thymidylate kinase YP_279053.1 | Frameshift |
| 300098 | 299758 | 299569 | 299801 | A | A | Δ A | Δ A | Thymidylate kinase YP_279053.1 | Frameshift |
| 300772 | 300432 | 300240 | 300474 | A | A | Δ A | Δ A | DNA polymerase III subunit delta YP_279054.1 | Frameshift |
| 305732 | 305384 | 305184 | 305426 | T | T | Δ T | Δ T | DNA ligase YP_279060.1 | Frameshift |
| 328394 | 327999 | 327800 | 328060 | A | A | Δ A | Δ A | CDP-diacylglycerol-glycerol-3-phosphate-3-phosphatidyal transferase YP_279075.1 | Frameshift |

Amended

Figure 1A - 3

| Number | | | | Nucleotide Base | | | | Gene | Nature of mutation |
|---|---|---|---|---|---|---|---|---|---|
| J | LKR | MTR | P12 | J | LKR | MTR | P12 | | |
| 377689 | 377235 | 377020 | 377319 | T | T | Δ T | Δ T | putative ISMHp1 transposase YP_279110.1 | Frameshift |
| 389842 | 389376 | 389157 | 389461 | T | T | Δ T | Δ T | hypothetical protein YP_279121.1 | Frameshift |
| 393661 | 393192 | 392955 | 393271 | A | A | Δ A | Δ A | Intergenic | |
| 410563 | 410082 | 409835 | 410164 | T | T | Δ T | Δ T | Intergenic | |
| 412710 | 412226 | 411976 | 412307 | T | T | Δ T | Δ T | Hypothetical protein YP_279136.1 | Frameshift |
| 413717 | 413232 | 412980 | 413313 | A | A | Δ A | Δ A | Hypothetical protein YP_279138.1 | Frameshift |
| 426313 | 425818 | 425552 | 426313 | A | A | Δ A | Δ A | Intergenic | |
| 426326 | 425831 | 425563 | 425910 | T | T | Δ T | Δ T | Intergenic | |
| 431650 | 431149 | 430879 | 431226 | A | A | Δ A | Δ A | Intergenic | |
| 431669 | 431168 | 430898 | 431244 | T | T | Δ T | Δ T | Intergenic | |
| 437234 | 436729 | 436455 | 436804 | T | T | Δ T | Δ T | putative ABC transport system permease protein p69-like YP_279157.1 | Frameshift |
| 442618 | 442107 | 441827 | 442184 | A | A | Δ A | Δ A | putative lipoprotein YP_279161.1 | Frameshift |
| | | | | | | | | | |
| 475493 | 474937 | 474655 | 475032 | A | A | Δ A | Δ A | hypothetical proteinYP_279182.1 | Frameshift |
| 477621 | 477066 | 476785 | 477160 | A | A | Δ A | Δ A | Intergenic | |
| 477622 | 477067 | 476786 | 477161 | A | A | Δ A | Δ A | Intergenic | |
| 479170 | 478611 | 478329 | 478704 | T | T | Δ T | Δ T | Intergenic | |
| 485869 | 485296 | 485023 | 485399 | T | T | Δ T | Δ T | hypothetical protein YP_279196.1 | Frameshift |
| 486911 | 486337 | 486063 | 486440 | A | A | Δ A | Δ A | hypothetical protein YP_279196.1 | Frameshift |
| 491786 | 491200 | 490917 | 491301 | A | A | Δ A | Δ A | Intergenic | |
| 502594 | 501992 | 501705 | 502097 | T | T | Δ T | Δ T | Intergenic | |
| 512112 | 511491 | 511193 | 511596 | T | T | Δ T | Δ T | hypothetical protein YP_279217.1 | Frameshift |
| 519298 | 518667 | 518366 | 518771 | A | A | Δ A | Δ A | transketolase YP_279223.1 | Frameshift |
| 524764 | 524126 | 523821 | 524234 | T | T | Δ T | Δ T | Intergenic | |
| 534108 | 533459 | 533152 | 533572 | T | T | Δ T | Δ T | hypothetical protein YP_279235.1 | Frameshift |
| 539244 | 538589 | 538279 | 538702 | A | A | Δ A | Δ A | Intergenic | |
| 558831 | 558174 | 557849 | 558286 | T | T | Δ T | Δ T | hypothetical protein YP_279242.1 | Frameshift |
| 564250 | 563590 | 563258 | 563701 | T | T | Δ T | Δ T | Intergenic | |
| 569870 | 569202 | 568872 | 569320 | A | A | Δ A | Δ A | hypothetical protein YP_279247.1 | Frameshift |
| 586142 | 585455 | 585116 | 585569 | T | T | Δ T | Δ T | Intergenic | |
| 590751 | 590056 | 589710 | 590170 | A | A | Δ A | Δ A | hypothetical protein YP_279262.1 | Frameshift |

Amended

Figure 1A - 4

| Number | | | | Nucleotide Base | | | | Gene | Nature of mutation |
|---|---|---|---|---|---|---|---|---|---|
| J | LKR | MTR | P12 | J | LKR | MTR | P12 | | |
| 591871 | 591173 | 590826 | 591288 | T | T | Δ T | Δ T | hypothetical protein YP_279264.1 | Frameshift |
| 608132 | 607408 | 607065 | 607536 | T | T | Δ T | Δ T | hypothetical protein YP_279278.1 | Frameshift |
| 613911 | 613182 | 612838 | 613309 | A | A | Δ A | Δ A | Intergenic | |
| 615799 | 615068 | 614722 | 615194 | T | T | Δ T | Δ T | hypothetical protein YP_279283.1 | Frameshift |
| 615804 | 615073 | 614726 | 615198 | T | T | Δ T | Δ T | hypothetical protein YP_279283.1 | Frameshift |
| 625870 | 625093 | 624770 | 625256 | - | - | ins T | ins T | Glutamine (Q) insertion into Putative P216 surface protein YP_279290.1 | In frame single codon insertion |
| 625871 | 625094 | 624771 | 625257 | - | - | ins T | ins T | | |
| 625872 | 625095 | 624772 | 625258 | - | - | ins G | ins G | | |
| 628031 | 627256 | 626935 | 627422 | T | T | Δ T | Δ T | putative P216 surface protein YP_279290.1 | Frameshift |
| 634595 | 633816 | 633492 | 633982 | A | A | Δ A | Δ A | Intergenic | |
| 683823 | 682998 | 682639 | 683159 | A | A | Δ A | Δ A | DNA gyrase subunit A YP_279326.1 | Frameshift |
| 699407 | 698575 | 698206 | 698737 | A | A | Δ A | Δ A | hypothetical protein YP_279337.1 | Frameshift |
| 699923 | 699090 | 698720 | 699252 | T | T | Δ T | Δ T | hypothetical protein YP_279338.1 | Frameshift |
| 733700 | 732825 | 732446 | 732988 | C | C | Δ C | Δ C | Intergenic | |
| 737657 | 736776 | 736391 | 736941 | T | T | Δ T | Δ T | hypothetical protein YP_279366.1 | Frameshift |
| 748454 | 747553 | 747173 | 747719 | A | A | Δ A | Δ A | Intergenic | |
| 768571 | 767650 | 767256 | 767824 | A | A | Δ A | Δ A | ribonuclease HII YP_279388.1 | Frameshift |
| 785221 | 784232 | 783880 | 784420 | A | A | Δ A | Δ A | inorganic pyrophosphatase YP_279400.1 | Frameshift |
| 810058 | 809042 | 808665 | 809219 | A | A | Δ A | Δ A | Intergenic | |
| 810061 | 809045 | 808667 | 809221 | A | A | Δ A | Δ A | Intergenic | |
| 817687 | 816667 | 816280 | 816841 | T | T | Δ T | Δ T | putative ABC transporter ATP-binding-Pr1 YP_279419.1 | Frameshift |
| 875082 | 873990 | 873584 | 874167 | T | T | Δ T | Δ T | putative adhesion like-protein P146 YP_279457.1 | Frameshift |
| 882753 | 881654 | 881253 | 881828 | T | T | Δ T | Δ T | Intergenic | |
| 883049 | 881950 | 881546 | 882123 | T | T | Δ T | Δ T | Intergenic | |
| 896830 | 895718 | 895303 | 895892 | A | A | Δ A | Δ A | putative inner membrane protein translocase component YidC YP_279468.1 | Frameshift |

Amended

Figure 1B - 1

| Mutation # | Nucleotide position (base pair) | | | | Nucleotide Base (positive strand) | | | | Translated Codon | | | | Amino Acid | | | | Gene [NCBI Ref Sequence] |
|---|---|---|---|---|---|---|---|---|---|---|---|---|---|---|---|---|---|
| | J | LKR | MTR | P12 | J | LKR | MTR | P12 | J | LKR | MTR | P12 | J | LKR | MTR | P12 | |
| 1 | 6060 | 6055 | 6051 | 6055 | G | G | A | A | TTG | TTG | TTA | TTA | Leu | Leu | Leu | Leu | Putative MgpA-like protein [YP_278810.1] |
| | | | | | | | | | | | | | No change | | | | |
| 2 | 10909 | 10898 | 10889 | 10900 | G | G | A | A | GCC | GCC | ACC | ACC | Ala | Ala | Thr | Thr | Hypothetical protein [YP_278814.1] |
| 3 | 96181 | 96082 | 96022 | 96106 | A | A | G | G | Intergenic | | | | Untranslated | | | | Intergenic sequence between amino acid permease [YP_278882.1] and NADH oxidase [YP_278883.1] |
| 4 | 118293 | 118165 | 118090 | 118184 | A | A | G | G | GAC | GAC | GGC | GGC | Asp | Asp | Gly | Gly | Hypothetical protein [YP_278896.1] |
| 5 | 123175 | 123040 | 122956 | 123057 | G | G | T | T | GTT | GTT | TTT | TTT | Val | Val | Phe | Phe | Putative outer membrane protein P95 [YP_278901.1] |
| 6 | 163911 | 163705 | 163605 | 163716 | G | G | A | A | TCC | TCC | TTC | TTC | Ser | Ser | Phe | Phe | Uracil-DNA glycosylase [YP_278929.1] |

Amended

Figure 1B - 2

| Mutation # | Nucleotide position (base pair) | | | | Nucleotide Base (positive strand) | | | | Translated Codon | | | | Amino Acid | | | | Gene [NCBI Ref Sequence] |
|---|---|---|---|---|---|---|---|---|---|---|---|---|---|---|---|---|---|
| | J | LKR | MTR | P12 | J | LKR | MTR | P12 | J | LKR | MTR | P12 | J | LKR | MTR | P12 | |
| 7 | 246307 | 246019 | 245861 | 246052 | G | G | T | T | GGC | GGC | TGC | TGC | Gly | Gly | Cys | Cys | Hypothetical protein [YP_279014.1] |
| 8 | 259905 | 259596 | 259427 | 259630 | G | G | A | A | STOP | STOP | STOP | STOP | No change | | | | myo-inositol catabolism protein [YP_279022.1] |
| 9 | 330948 | 330552 | 330348 | 330612 | A | A | G | G | AAT | AAT | AAC | AAC | Asn | Asn | Asn | Asn | DNA topoisomerase I [YP_279077.1] |
| 10 | 330998 | 330602 | 330398 | 330662 | A | A | G | G | TAT | TAT | CAT | CAT | Tyr | Tyr | His | His | DNA topoisomerase I [YP_279077.1] |
| 11 | 379103 | 378647 | 378432 | 378731 | C | C | G | G | Intergenic | | | | Untranslated | | | | Intergenic sequence between putative ISMHp1 transposase [YP_279110.1] and hyopthetical protein [YP_279111.1] |
| 12 | 385924 | 385463 | 385243 | 385547 | C | C | T | T | GAA | GAA | AAA | AAA | Glu | Glu | Lys | Lys | Hypothetical protein [YP_279117.1] |
| 13 | 411019 | 410537 | 410289 | 410618 | G | G | A | A | Truncated (pseudo) | | | | | | | | Putative transposase |

Amended

Figure 1B - 3

| Mutation # | Nucleotide position (base pair) | | | | Nucleotide Base (positive strand) | | | | Translated Codon | | | | Amino Acid | | | | Gene [NCBI Ref Sequence] |
|---|---|---|---|---|---|---|---|---|---|---|---|---|---|---|---|---|---|
| | J | LKR | MTR | P12 | J | LKR | MTR | P12 | J | LKR | MTR | P12 | J | LKR | MTR | P12 | |
| | | | | | | | | | | | | | | | | | truncated (pseudo) |
| 14 | 438867 | 438357 | 438081 | 438434 | G | G | A | A | GGA | GGA | GAA | GAA | Gly | Gly | Glu | Glu | Hypothetical protein [YP_279159.1] |
| 15 | 445620 | 445107 | 444821 | 445182 | C | C | A | A | CCC | CCC | CCA | CCA | Pro | Pro | Pro | Pro | Putative lipoprotein [YP_279163.1] |
| | | | | | | | | | | | | | No change | | | | |
| 16 | 446756 | 446242 | 445952 | 446317 | C | C | A | A | CTT | CTT | ATT | ATT | Leu | Leu | Ile | Ile | Putative ABC transporter permease protein [YP_279164.2] |
| 17 | 478690 | 478134 | 477852 | 478227 | G | G | A | A | Intergenic | | | | Untranslated | | | | Intergenic sequence between putative transposase [YP_279183.1] and hypothetical protein [YP_279186.1] |
| 18 | 495301 | 494704 | 494422 | 494807 | G | G | T | T | GGT | GGT | TGT | TGT | Gly | Gly | Cys | Cys | Nicotinate phosphoribosyltransferase [YP_279204.1] |

Amended

Figure 1B - 4

| Mutation # | Nucleotide position (base pair) | | | | Nucleotide Base (positive strand) | | | | Translated Codon | | | | Amino Acid | | | | Gene [NCBI Ref Sequence] |
|---|---|---|---|---|---|---|---|---|---|---|---|---|---|---|---|---|---|
| | J | LKR | MTR | P12 | J | LKR | MTR | P12 | J | LKR | MTR | P12 | J | LKR | MTR | P12 | |
| 19 | 538653 | 538003 | 537692 | 538116 | G | G | A | A | GCT | GCT | GTT | GTT | Ala | Ala | Val | Val | Hypothetical protein [YP_279238.1] |
| 20 | 539150 | 538495 | 538185 | 538608 | A | A | C | C | Intergenic | | | | Untranslated | | | | Intergenic sequence between two hypothetical proteins [YP_279238.1] and [YP_279239.1] |
| 21 | 539587 | 538926 | 538615 | 539041 | T | T | C | C | Intergenic | | | | Untranslated | | | | Intergenic sequence between two hypothetical proteins [YP_279238.1] and [YP_279239.1] |
| 22 | 539601 | 538940 | 538629 | 539055 | G | G | C | C | Intergenic | | | | Untranslated | | | | Intergenic sequence between two hypothetical proteins [YP_279238.1] and [YP_279239.1] |

Amended

Figure 1B - 5

| Mutation # | Nucleotide position (base pair) | | | | Nucleotide Base (positive strand) | | | | Translated Codon | | | | Amino Acid | | | | Gene [NCBI Ref Sequence] |
|---|---|---|---|---|---|---|---|---|---|---|---|---|---|---|---|---|---|
| | J | LKR | MTR | P12 | J | LKR | MTR | P12 | J | LKR | MTR | P12 | J | LKR | MTR | P12 | |
| 23 | 550628 | 549965 | 549652 | 550083 | C | C | A | A | GGG | GGG | GTG | GTG | Gly | Gly | Val | Val | Hypothetical protein [YP_279240.1] |
| 24 | 554103 | 553440 | 553126 | 553557 | G | G | A | A | CCC | CCC | CTC | CTC | Pro | Pro | Leu | Leu | Hypothetical protein [YP_279241.1] |
| 25 | 555585 | 554921 | 554606 | 555039 | G | G | T | T | ACT | ACT | AAT | AAT | Thr | Thr | Asn | Asn | Hypothetical protein [YP_279241.1] |
| 26 | 583967 | 583282 | 582945 | 583395 | G | G | T | T | GGG | GGG | GTG | GTG | Gly | Gly | Val | Val | Hypothetical protein [YP_279257.1] |
| 27 | 599805 | 599096 | 598745 | 599214 | C | C | A | A | GAT | GAT | TAT | TAT | Asp | Asp | Tyr | Tyr | Hypothetical protein [YP_279271.1] |
| 28 | 615445 | 614715 | 614370 | 614840 | C | C | A | A | AGT | AGT | ATT | ATT | Ser | Ser | Ile | Ile | Hypothetical protein [YP_279283.1] |
| 29 | 743961 | 743064 | 742685 | 743229 | G | G | A | A | GCA | GCA | GTA | GTA | Ala | Ala | Val | Val | Putative PTS system N-acetylglucosamine-specific II ABC component [YP_279370.1] |
| 30 | 848512 | 847456 | 847061 | 847629 | C | C | G | G | ATG | ATG | ATC | ATC | Met | Met | Ile | Ile | Leucyl-tRNA synthetase YP_279441.1 |
| 31 | 881437 | 880340 | 879938 | 880514 | A | A | G | G | Untranslated | | | | Untranslated | | | | 16S ribosomal |

Amended

Figure 1B - 6

| Mutation # | Nucleotide position (base pair) | | | | Nucleotide Base (positive strand) | | | | Translated Codon | | | | Amino Acid | | | | Gene [NCBI Ref Sequence] |
|---|---|---|---|---|---|---|---|---|---|---|---|---|---|---|---|---|---|
| | J | LKR | MTR | P12 | J | LKR | MTR | P12 | J | LKR | MTR | P12 | J | LKR | MTR | P12 | |
| | | | | | | | | | | | | | | | | | RNA MHJ_0709 |

J - Published whole genome sequence of *M. hyopneumoniae* J strain (NC_007295.1; SEQ ID NO:5)
LKR - Parental strain of Vaxsafe® MHP
MTR - Master Seed Level (3 passages from Master seed) of Vaxsafe® MHP
P12 - Late passage (12 passages from Working Seed) of Vaxsafe® MHP Amended

Figure 1C - 1

| Mutation # | Gene [NCBI Reference Sequence] | Amino acid (aa) change [residue number] | Amino acid characteristic original aa | Amino acid characteristic mutated aa |
|---|---|---|---|---|
| 1 | Putative MgpA-like protein [YP_278810.1] | L[249]L | Aliphatic hydrophobic neutral | Aliphatic hydrophobic neutral |
| 2 | Hypothetical protein [YP_278814.1] | A[574]T | Aliphatic hydrophobic neutral | Polar hydrophilic neutral |
| 3 | Intergenic sequence between amino acid permease [YP_278882.1] and NADH oxidase [YP_278883.1] | | | |
| 4 | Hypothetical protein [YP_278896.1] | D[299]G | Polar hydrophilic charged (-) | Aliphatic neutral |
| 5 | Putative outer membrane protein P95 [YP_278901.1] | V[37]F | Aliphatic hydrophobic neutral | Aromatic hydrophobic neutral |
| 6 | Uracil-DNA glycosylase [YP_278929.1] | S[131]F | Polar hydrophilic neutral | Aromatic hydrophobic neutral |
| 7 | Hypothetical protein [YP_279014.1] | G[1884]C | Aliphatic neutral | Polar hydrophobic neutral |
| 8 | myo-inositol catabolism protein iolC [YP_279022.1] | Stop Stop | | |
| 9 | DNA topoisomerase I [YP_279077.1] | N[39]N | Polar hydrophilic neutral | Polar hydrophilic neutral |
| 10 | DNA topoisomerase I [YP_279077.1] | Y[23]H | Aromatic polar hydrophobic | Aromatic polar hydrophilic charge (+) |
| 11 | Intergenic sequence between | | | |

Amended

Figure 1C - 2

| Mutation # | Gene [NCBI Reference Sequence] | Amino acid (aa) change [residue number] | Amino acid characteristic | Amino acid characteristic |
|---|---|---|---|---|
| | | | original aa | mutated aa |
| | putative ISMHp1 transposase [YP_279110.1] and hyopthetical protein [YP_279111.1] | | | |
| 12 | Hypothetical protein [YP_279117.1] | E[18]K | Polar hydrophilic charged (-) | Polar hydrophilic charged (+) |
| 13 | Putative transposase truncated (pseudo) | | | |
| 14 | Hypothetical protein [YP_279159.1] | G[73]E | Aliphatic neutral | Polar hydrophilic charged (-) |
| 15 | Putative lipoprotein [YP_279163.1] | P[50]P | Hydrophobic neutral | Hydrophobic neutral |
| 16 | Putative ABC transporter permease protein [YP_279164.2] | L[114]I | Aliphatic hydrophobic neutral | Aliphatic hydrophobic neutral |
| 17 | Intergenic sequence between putative transposase [YP_279183.1] and hypothetical protein [YP_279186.1] | | | |
| 18 | Nicotinate phosphoribosyltransferase [YP_279204.1] | G[90]C | Aliphatic neutral | Polar hydrophobic neutral |
| 19 | Hypothetical protein [YP_279238.1] | A[128]V | Aliphatic hydrophobic neutral | Aliphatic hydrophobic neutral |
| 20 | Intergenic sequence between two hypothetical proteins [YP_279238.1] and [YP_279239.1] | | | |

Amended

Figure 1C - 3

| Mutation # | Gene [NCBI Reference Sequence] | Amino acid (aa) change [residue number] | Amino acid characteristic | Amino acid characteristic |
|---|---|---|---|---|
| | | | original aa | mutated aa |
| 21 | Intergenic sequence between two hypothetical proteins [YP_279238.1] and [YP_279239.1] | | | |
| 22 | Intergenic sequence between two hypothetical proteins [YP_279238.1] and [YP_279239.1] | | | |
| 23 | Hypothetical protein [YP_279240.1] | G[204]V | Aliphatic neutral | Aliphatic hydrophobic neutral |
| 24 | Hypothetical protein [YP_279241.1] | P[650]L | Hydrophobic neutral | Aliphatic hydrophobic neutral |
| 25 | Hypothetical protein [YP_279241.1] | T[156]N | Polar hydrophilic neutral | Polar hydrophilic neutral |
| 26 | Hypothetical protein [YP_279257.1] | G584V | Aliphatic neutral | Aliphatic hydrophobic neutral |
| 27 | Hypothetical protein [YP_279271.1] | D[230]Y | Polar hydrophilic charged (-) | Aromatic polar hydrophobic |
| 28 | Hypothetical protein [YP_279283.1] | S[389]I | Polar hydrophilic neutral | Aliphatic hydrophobic neutral |
| 29 | Putative PTS system N-acetylglucosamine-specific II ABC component [YP_279370.1] | A[159]V | Aliphatic hydrophobic neutral | aliphatic hydrophobic neutral |
| 30 | Leucyl-tRNA synthetase YP_279441.1 | M[440]I | Hydrophobic neutral | Aliphatic hydrophobic neutral |

Amended

Figure 1C - 4

| Mutation # | Gene [NCBI Reference Sequence] | Amino acid (aa) change [residue number] | Amino acid characteristic | Amino acid characteristic |
|---|---|---|---|---|
| | | | original aa | mutated aa |
| 31 | 16S ribosomal RNA MHJ_0709 | | | |

J - Published whole genome sequence of *M. hyopneumoniae* J strain (NC_007295.1; SEQ ID NO:5)
LKR - Parental strain of Vaxsafe® MHP
MTR - Master Seed Level (3 passages from Master seed) of Vaxsafe® MHP
P12 - Late passage (12 passages from Working Seed) of Vaxsafe® MHP Amended Figure 4
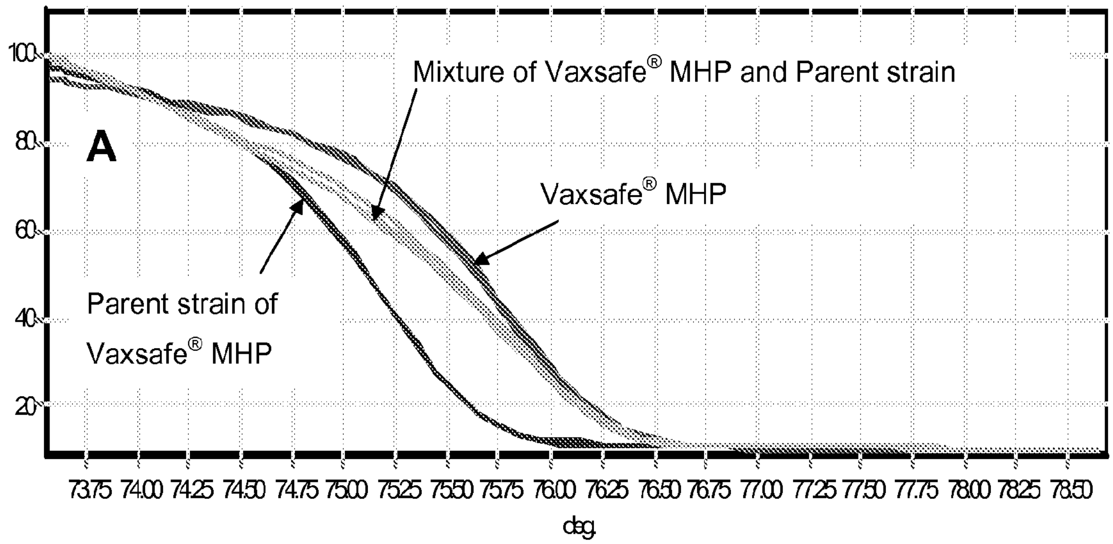
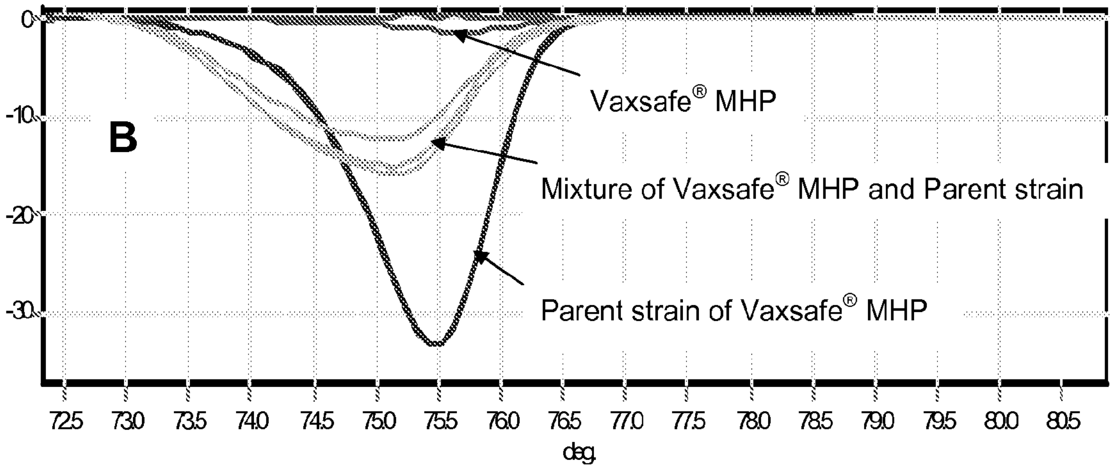

METHODS RELATING TO AN ATTENUATED MYCOPLASMA

FIELD

The present invention relates to uses for attenuated *Mycoplasma hyopneumoniae*, such as in methods for diagnosing the presence of attenuated *Mycoplasma* in a sample and for selecting for attenuated *Mycoplasma*.

BACKGROUND

*Mycoplasma hyopneumoniae* is the etiological agent of swine Mycoplasmal pneumonia (also called enzootic pneumonia (EP)). It is one of the most common and economically significant respiratory diseases affecting swine production worldwide. The disease is associated with secondary infections, high-morbidity and low-mortality rates, low feed conversion and can be attributed to global economic losses estimated at about $1 billion per year.

In EP, *Mycoplasma hyopneumoniae* bacteria attach to the cilia of epithelial cells in the lungs of swine destroying healthy normal cilia allowing for opportunistic organisms to establish themselves into the respiratory tissue causing disease. Once established, *M. hyopneumoniae* causes lesions in the lungs of pigs.

The disease is highly contagious and transmission is usually through direct contact with infected respiratory tract secretions, for example droplets ejected from the snout or mouth on sneezing or coughing.

Several vaccines against *M. hyopneumoniae* currently exist. Most current vaccines are provided by about 10 companies with 22 vaccine brands registered as either single or bi/multivalent. All are killed or inactivated *M. hyopneumoniae* preparations.

Examples of whole cell inactivated *M. hyopneumoniae* vaccines include RESPISURE™ and STELLAMUNE™ (Pfizer), SUVAXYN *M. HYO*™ (Fort Dodge), HYORESP™ (Merial), M+PAC™ (Schering-Plough) and PORCILIS™ (Intervet).

While some vaccines can reduce the severity of EP, none of the available whole cell killed or inactivated vaccines provide full protection from *M. hyopneumoniae* infection.

Our co-pending application, published as WO2010/132932, describes a live attenuated *M. hyopneumoniae* strain which is temperature sensitive. This strain is designated ts-19 and was deposited under the Budapest Treaty at the National Measurements Institute as NM 04/41259 on 13 May 2004. This strain, when incorporated into a vaccine, is able to confer protective immunity against *M. hyopneumoniae* in vaccinated pigs.

SUMMARY

A first aspect provides a method for identifying an attenuated *Mycoplasma* bacterium, the method comprising assaying *Mycoplasma* bacteria for presence of a mutation in at least one gene encoding a protein listed in Table 1 or in a nucleic acid molecule listed in any one or more of Tables 2 to 5, wherein the presence of the mutation indicates that the *Mycoplasma* is attenuated.

Attenuated vaccines are generally advantageous because they present all the relevant immunogenic determinants of an infectious agent in its natural form to the host's immune system and the need for relatively small amounts of the immunising agent due to the ability of the agent to multiply in the vaccinated host. Methods for attenuating include passaging a virulent strain multiple times or exposure to irradiation or chemicals. It is assumed that these methods introduce mutations in the genome which render the microorganism less virulent but still capable of replication.

Disadvantages of these approaches are that they introduce random mutations that are not characterised at the molecular level. Also methods for selecting for attenuation, such as by selecting for associated temperature sensitivity are often time consuming, produce false results as a temperature sensitive strain may not be attenuated and an attenuated strain need not be temperature sensitive, and require a great deal of trial and error. Additionally the attenuated strain may undergo further mutation and revert to virulence. An alternative strategy would be to generate non-reversible genetically defined attenuated *Mycoplasma*. However to date the genes affected by attenuation of *Mycoplasma* have not been identified. The present invention identifies mutations in an attenuated *Mycoplasma* as compared to its parent strain and utilises this knowledge to determine which genes should be mutated to provide an attenuated *Mycoplasma*.

The method of the first aspect allows selection for an attenuated *Mycoplasma* strain and to identify if an attenuated strain has returned to virulence.

A second aspect provides a method for generating an attenuated *Mycoplasma*, the method comprising subjecting an initial population of *Mycoplasma* bacteria to attenuating conditions, thereby producing a putatively attenuated bacterial population and assaying individual clones of the putatively attenuated bacterial population for presence of a mutation in at least one gene encoding a protein listed in Table 1 or in a nucleic acid molecule listed in any one or more of Tables 2 to 5 wherein the presence of the mutation indicates that the *Mycoplasma* is attenuated.

A third aspect provides an attenuated *Mycoplasma* bacteria selected by the method of the first aspect or generated by the method of the second aspect.

A fourth aspect provides an immunogenic composition comprising the attenuated *Mycoplasma* bacteria of the third aspect.

A fifth aspect provides a *Mycoplasma* vaccine comprising the immunogenic composition of the fourth aspect.

A sixth aspect provides a method of inducing protective immunity against a disease caused by a *Mycoplasma* in a subject, the method comprising administering to the subject a protective amount of the attenuated *Mycoplasma* of the third aspect, the immunogenic composition of the fourth aspect or the vaccine of the fifth aspect.

An alternative aspect provides the attenuated *Mycoplasma* of the third aspect, the immunogenic composition of the fourth aspect or the vaccine of the fifth aspect for eliciting protective immunity against a disease cause by *Mycoplasma*.

A further alternative aspect provides for use of the attenuated *Mycoplasma* of the third aspect, the immunogenic composition of the fourth aspect or the vaccine of the fifth aspect in the manufacture of a medicament for preventing a disease caused by *Mycoplasma*.

The inventors determined the nucleic acid sequence of the attenuated *Mycoplasma hyopneumoniae* strain (ts-19) deposited with the National Measurements Institute under accession number NM04/41259, and the sequence of the virulent strain from which the attenuated strain was derived by NTG mutation (*Mycoplasma hyopneumoniae* isolate LKR, Lloyd & Etheridge (1981) J. Comp. Path. 91:77-83). Using analysis of the aligned sequences together with their knowledge in the field, the inventors were able to identify certain mutations they believe to be associated with attenuation. The inventors consider that these mutations are markers for attenuation in

*Mycoplasma hyopneumoniae* and in other *Mycoplasma* and can be used to select for attenuated *Mycoplasma* strains. This is particularly useful when attenuation conditions used to generate an attenuated *Mycoplasma* cause random mutagenesis. Selection for the mutations provides a simple method of determining if a strain of *Mycoplasma* is attenuated and therefore suitable for formulation into a vaccine.

A seventh aspect provides a method for determining if an animal is infected with an attenuated or virulent strain of *Mycoplasma*, the method comprising assaying a sample comprising a *Mycoplasma* from an animal for presence of a mutation in at least one gene encoding a protein listed in Table 1 or in a nucleic acid molecule listed in any one or more of Tables 2 to 5, wherein the absence of the mutation indicates that the animal is infected with virulent *Mycoplasma*.

An eighth aspect provides a method for distinguishing animals vaccinated with an attenuated *Mycoplasma* strain from those infected with *Mycoplasma*, the method comprising assaying a sample comprising a *Mycoplasma* for presence of a mutation in at least one gene encoding a protein listed in Table 1 or in a nucleic acid molecule listed in any one or more of Tables 2 to 5 wherein the presence of the mutation in the sample indicates that animal from which the sample was taken has been vaccinated with an attenuated *Mycoplasma* vaccine.

*Mycoplasma hyopneumoniae* is a highly contagious and chronic disease causing enzootic pneumonia in pigs. This disease is endemic world wide. The methods of the sevenths and eighth aspects allow differentiation of pigs which have been vaccinated with an attenuated strain from those that are infected or whose vaccine strain has reverted to virulence.

A ninth aspect provides a kit comprising primers or probes specific for a mutation in one or more genes encoding a protein listed in Table 1 or in a nucleic acid molecule listed in any one or more of Tables 2 to 5.

A tenth aspect provides a kit comprising primers or probes specific for at least one mutation shown in FIG. 1.

The kits of the ninth and tenth aspects may be used in the methods of the first, seventh or eighth aspects.

DETAILED DESCRIPTION

*M. hyopneumoniae* strain "LKR" was originally isolated from an abattoir specimen (Lloyd and Etheridge 1981, J of Comp Path 91:77-83). The organism was reisolated from experimentally infected pigs prior to being passaged about 10 times in acellular medium to reach clonal isolation (CSIRO, Victoria). The clone was then submitted to the University of Adelaide *Mycoplasma* collection, South Australia. The LKR isolate was then obtained by the University of Melbourne, Department of Veterinary Science (*Mycoplasma* Group), where it underwent 3 in vitro passages in modified Friss broth, for storage. The stored vials were designated "LKR P3 29/5/97". This clone represents the parental strain.

LKR P3 29/5/97 was in vitro passaged and subjected to NTG mutagenesis (200 mg/mL) using a method described previously (Nonamura and Imada (1982) Avian Diseases 26:763-775). A temperature sensitive clone ("ts-19") was selected from an agar plate and cultured in 3 mL modified Friss broth. Passage number for this clone was designated "P0" and had subsequently undergone a further four in vitro passages at 1:4 v/v dilution per passage in modified Friss broth. The final passage level was designated "LKR ts-19 P4 MS".

LKR ts-19 P4 MS underwent a number of in vitro dilution passages in Modified Friss broth to reach a dilution of $3.2\times10^{-21}$. The final mutant clone was designated "LKR ts-19 $3.2\times10^{-21}$".

LKR ts-19 $3.2\times10^{-21}$ was freeze dried and submitted to Australian Government Analytical Laboratories (Budapest Treaty on the International recognition of the deposit of organisms for the purposes of patent procedure) under the accession number NM04/41259.

*Mycoplasmas* have a highly reduced genome size which reflects their limited biosynthetic abilities and their parasitic like dependence on their host. In light of the limited redundancy in their genomes, NTG mutagenesis of a particular component of a pathway may have a significant effect on the survival of a *Mycoplasma* cell. NTG mutagenesis results in random mutations (nucleotide transitions, transversions, deletions or insertions) within the genome. This would result in a population of variant genomes each containing either one or more mutations. Presumably many of the variant genomes would not survive due to a critical gene or genes being rendered dysfunctional. If the mutations do not incur a detrimental effect on the organisms ability to grow then those surviving variant organisms can undergo further selection (e.g. temperature selection). In the development of ts-19, the selection was based on the ability of the variant strain to grow to high titre at a temperature of 33° C. and the reduced ability to grow at 39.5° C. Based on whole genome sequence comparison between *Mycoplasma hyopneumoniae* vaccine strain ts-19 and that of the parent strain (LKR), a number of mutations (nucleotide changes) have been identified within the genome of ts-19. These mutations included nucleotide substitutions (transitions and transversions), as well as deletions and insertions.

The mutations were located around the entire genome and include a range of expressed genes as well as hypothetical proteins and non-coding sequences. Table 1 lists the known genes that have been mutated by base substitutions, deletions or insertions. The genes have been categorized according to their main function.

Table 2 shows silent mutations identified in genes and in non-coding regions of ts-19. Table 3 shows deletions identified in non-coding regions of ts-19. Table 4 shows mutations identified in hypothetical genes of ts-19. Table 5 shows deletions identified in hypothetical genes of ts-19.

The exact nature of the specific differences between *M. hyo* J strain, *M. hyo* LKR strain, and the ts-19 attenuated strain (master and after 12 in vitro passages) are shown in FIG. 1.

It is postulated that temperature sensitivity and attenuation of an organism results from either a single or multiple mutations that act individually or in concert to produce the phenotypic characteristics.

Persons skilled in the art would readily appreciate how to identify if a *M. hyo* strain contained a mutation in one of the genes listed in Table 1 by determining if there is a difference between the reference sequence provide (e.g. YP_278901.1) and the sequence of the attenuated strain ts-19, as deposited as NM04/41259.

In one embodiment the attenuated strain comprises at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34 or all of the mutations listed in Table 1, alone or in combination with at least one mutation listed in Table 2, 3, 4 or 5.

In one embodiment the attenuated strain comprises a mutation in one or each of the virulence factors, and/or one or each of the genes involved in carbohydrate metabolism, and/or the gene involved in phospholipid metabolism, and/or the gene involved in co-factor metabolism, and/or one or each of the genes involved in transcription or translation, and/or one or each of the genes involved in membrane transport, and/or one or each of the genes involved in DNA replication, repair or metabolism and/or the transposase gene listed in Table 1.

In one embodiment the attenuated strain comprises a mutation in each of the virulence factors.

Mutations found within the P95, P69, P216, P146 genes as well as lipoprotein genes are most likely to have an effect on attenuation as these genes have been described as being associated with virulence (Ferreira and de Castro et al., (2007). Genetic and Molecular Biology 30: p 245-255).

In another embodiment the attenuated strain comprises at least 1, 2, 3, 4, 5, 6, 7, 8, 9, 10 or all of the mutations listed in Table 2, alone or in combination with at least one mutation listed in Table 1, 3, 4 or 5.

In another embodiment the attenuated strain comprises at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or all of the mutations listed in Table 3, alone or in combination with at least one mutation listed in Table 1, 2, 4 or 5.

In another embodiment the attenuated strain comprises at least 1, 2, 3, 4, 5, 6, 7, 8, 9, 10 or all of the mutations listed in Table 4, alone or in combination with at least one mutation listed in Table 1, 2, 4 or 5.

In another embodiment the attenuated strain comprises at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31 or all of the mutations listed in Table 5, alone or in combination with at least one mutation listed in Table 1, 2, 3 or 4.

TABLE 1

Attenuating Mutations within genes of *M. hyopneumoniae* vaccine strain ts-19.

| | |
|---|---|
| Virulence factors: | |
| Putative outer membrane protein P95 | YP_278901.1 |
| Putative lipoprotein (MHJ_0213) | YP_279015.1 |
| Putative lipoprotein (MHJ_0362) | YP_279161.1 |
| Putative P216 surface protein | YP_279290.1 |
| Putative adhesion like-protein P146 | YP_279457.1 |
| Carbohydrate Metabolism: | |
| Triosephosphate isomerase | YP_278904.1 |
| Transketolase | YP_279223.1 |
| Putative PTS system N-acetylglucosamine-specific II ABC Component | YP_279370.1 |
| Phospholipid Metabolism: | |
| CDP-diacylglycerol-glycerol-3-phosphate-3-phosphatidyal transferase | YP_279075.1 |
| Co-factors Metabolism: | |
| Nicotinate phosphoribosyltransferase | YP_279204.1 |
| Transcription/translation: | |
| GidA gene [tRNA uridine 5-carboxymethylaminomethyl modification enzyme | YP_278808.1 |
| 50S Ribosomal protein L3 | YP_278992.1 |
| Leucyl-tRNA synthetase | YP_279441.1 |
| Isoleucyl tRNA synthetase | YP_278833.1 |
| Membrane Transport: | |
| Putative ABC transporter permease protein | YP_279164.2 |
| Putative ABC transporter ATP binding | YP_278823.1 |
| Putative chromate transport protein | YP_278943.1 |
| Putative ABC transporter ATP binding and permease protein | YP_278958.1 |
| Putative inner membrane protein translocase component YidC | YP_279468.1 |
| Putative ABC transport system permease protein p69-like | YP_279157.1 |

TABLE 1-continued

Attenuating Mutations within genes of *M. hyopneumoniae* vaccine strain ts-19.

| | |
|---|---|
| Putative ABC transporter permease protein | YP_279176.1 |
| Putative ABC transporter ATP-binding-Pr1 | YP_279419.1 |
| DNA replication/repair/metabolism | |
| DNA topoisomerase I | YP_279077.1 |
| Uracil-DNA glycosylase | YP_278929.1 |
| GTPase ObgE | YP_278842.1 |
| DNA polymerase IV | YP_278846.1 |
| Ribonucleotide-disulphate reductase subunit alpha | YP_279017.1 |
| Thymidylate kinase | YP_279053.1 |
| DNA polymerase III subunit delta | YP_279054.1 |
| DNA ligase | YP_279060.1 |
| DNA gyrase subunit A | YP_279326.1 |
| ribonuclease HII | YP_279388.1 |
| Inorganic pyrophosphatase | YP_279400.1 |
| Excinuclease ABC subunit C | YP_278867.1 |
| Transposase | |
| putative ISMHp1 transposase | YP_279110.1 |

YP_number indicates NCBI Reference Sequence

TABLE 2

Attenuating Mutations within *M. hyopneumoniae* vaccine strain ts-19 which are silent or in non-coding region.

| Mutation # | Silent mutations in genes and mutations in non-coding regions [NCBI Reference Sequence] |
|---|---|
| 1 | Putative MgpA-like protein [YP_278810.1] |
| 2 | Intergenic sequence between amino acid permease [YP_278882.1] and NADH oxidase [YP_278883.1] |
| 3 | myo-inositol catabolism protein [YP_279022.1] |
| 4 | Intergenic sequence between putative ISMHp1 transposase [YP_279110.1] and hyopthetical protein [YP_279111.1] |
| 5 | Putative transposase truncated (pseudo) |
| 6 | Putative lipoprotein [YP_279163.1] |
| 7 | Intergenic sequence between putative transposase [YP_279183.1] and hypothetical protein [YP_279186.1] |
| 8 | Intergenic sequence between two hypothetical proteins [YP_279238.1] and [YP_279239.1] |
| 9 | Intergenic sequence between two hypothetical proteins [YP_279238.1] and [YP_279239.1] |
| 10 | Intergenic sequence between two hypothetical proteins [YP_279238.1] and [YP_279239.1] |
| 11 | 16S ribosomal RNA MHJ_0709 |

TABLE 3

Deletion mutations in non-coding regions of the *M. hyopneumoniae* vaccine strain ts-19.

| Deletion # | Nucleotide position | Genomic region |
|---|---|---|
| 1 | 17111 | Intergenic |
| 2 | 48804 | Intergenic |
| 3 | 59468 | Intergenic |
| 4 | 66236 | Intergenic |
| 5 | 89570 | Intergenic |
| 6 | 94587 | Intergenic |
| 7 | 94589 | Intergenic |
| 8 | 104212 | Intergenic |
| 9 | 104213 | Intergenic |
| 10 | 117188 | Intergenic |
| 11 | 120729 | Intergenic |
| 12 | 133537 | Intergenic |
| 13 | 143156 | Intergenic |
| 14 | 143243 | Intergenic |
| 15 | 147100 | Intergenic |
| 16 | 153282 | Intergenic |
| 17 | 170050 | Intergenic |
| 18 | 187078 | Intergenic |

TABLE 3-continued

Deletion mutations in non-coding regions of the *M. hyopneumoniae* vaccine strain ts-19.

| Deletion # | Nucleotide position | Genomic region |
|---|---|---|
| 19 | 187103 | Intergenic |
| 20 | 213969 | Intergenic |
| 21 | 235066 | Intergenic |
| 22 | 246360 | Intergenic |
| 23 | 392955 | Intergenic |
| 24 | 409835 | Intergenic |
| 25 | 425552 | Intergenic |
| 26 | 425563 | Intergenic |
| 27 | 430879 | Intergenic |
| 28 | 430898 | Intergenic |
| 29 | 476785 | Intergenic |
| 30 | 476786 | Intergenic |
| 31 | 478329 | Intergenic |
| 32 | 490917 | Intergenic |
| 33 | 501705 | Intergenic |
| 34 | 523821 | Intergenic |
| 35 | 538279 | Intergenic |
| 36 | 563258 | Intergenic |
| 37 | 585116 | Intergenic |
| 38 | 612838 | Intergenic |
| 39 | 633492 | Intergenic |
| 40 | 732446 | Intergenic |
| 41 | 747173 | Intergenic |
| 42 | 808665 | Intergenic |
| 43 | 808667 | Intergenic |
| 44 | 881253 | Intergenic |
| 45 | 881546 | Intergenic |

TABLE 4

Mutations within hypothetical genes of the *M. hyopneumoniae* vaccine strain ts-19.

| Mutation # | Gene [NCBI Reference Sequence] |
|---|---|
| 1 | Hypothetical protein [YP_278814.1] |
| 2 | Hypothetical protein [YP_278896.1] |
| 3 | Hypothetical protein [YP_279014.1] |
| 4 | Hypothetical protein [YP_279117.1] |
| 5 | Hypothetical protein [YP_279159.1] |
| 6** | Hypothetical protein [YP_279238.1] |
| 7 | Hypothetical protein [YP_279240.1] |
| 8** | Hypothetical protein [YP_279241.1] |
| 9 | Hypothetical protein [YP_279257.1] |
| 10 | Hypothetical protein [YP_279271.1] |
| 11 | Hypothetical protein [YP_279283.1] |

**These hypothetical proteins have been described to be variable antigens (Ferreira and de Castro, (2007) supra.

TABLE 5

Deletions within hypothetical genes of the *M. hyopneumoniae* vaccine strain ts-19.

| Deletion # | Hypothetical Genes |
|---|---|
| 1 | Hypothetical protein YP_278812.1 |
| 2 | Hypothetical protein YP_278865.1 |
| 3 | Hypothetical protein YP_278873.1 |
| 4 | Hypothetical protein YP_278896.1 |
| 5 | Hypothetical protein YP_278896.1 |
| 6 | Hypothetical protein YP_278906.1 |
| 7 | Hypothetical protein YP_278917.1 |
| 8 | Hypothetical protein YP_278919.1 |
| 9 | Hypothetical protein YP_278948.1 |
| 10 | Hypothetical protein YP_278995.1 |
| 11 | Hypothetical protein YP_279003.1 |
| 12 | Hypothetical protein YP_279009.1 |
| 13 | Hypothetical protein YP_279032.2 |
| 14 | Hypothetical protein YP_279046.1 |
| 15 | Hypothetical protein YP_279121.1 |

TABLE 5-continued

Deletions within hypothetical genes of the *M. hyopneumoniae* vaccine strain ts-19.

| Deletion # | Hypothetical Genes |
|---|---|
| 16 | Hypothetical protein YP_279136.1 |
| 17 | Hypothetical protein YP_279138.1 |
| 18 | Hypothetical protein YP_279182.1 |
| 19 | Hypothetical protein YP_279196.1 |
| 20 | Hypothetical protein YP_279196.1 |
| 21 | Hypothetical protein YP_279217.1 |
| 22 | Hypothetical protein YP_279235.1 |
| 23 | Hypothetical protein YP_279242.1 |
| 24 | Hypothetical protein YP_279247.1 |
| 25 | Hypothetical protein YP_279262.1 |
| 26 | Hypothetical protein YP_279264.1 |
| 27 | Hypothetical protein YP_279278.1 |
| 28 | Hypothetical protein YP_279283.1 |
| 29 | Hypothetical protein YP_279283.1 |
| 30 | Hypothetical protein YP_279337.1 |
| 31 | Hypothetical protein YP_279338.1 |
| 32 | Hypothetical protein YP_279366.1 |

DETAILED DESCRIPTION

The present invention is based on the determination of the nucleic acid sequence of a temperature sensitive attenuated *M. hyo* strain (ts-19) and its parent strain. Alignment of these strains and others has allowed the location and nature of mutations in the attenuated strain to be identified.

Temperature sensitive mutations fall into general classes: those generating thermolabile proteins; and those generating defects in protein synthesis, folding or assembly. In the case of the thermolabile proteins, the is mutants of a gene may be expressed at a higher level at the permissive temperature (33° C. for ts-19) and at a lower level at the non-permissive temperature (39.5° C. for ts-19).

As used herein, the term “mutation” refers to any detectable change in genetic material, e.g. DNA, RNA, cDNA or any process, mechanism or result of such a change. Such mutations may be point mutations (i.e., mutations in which one or more bases within the nucleic acid sequence have been replaced by a different base), insertion mutations (i.e, mutations in which the total length of the nucleic acid molecule or gene has been increased by the insertion of one or more bases), deletion mutations (mutations in which the total length of the nucleic acid molecule or gene has been decreased by removal of one or more bases) and inversion mutations (mutations in which a region of two or more bases has been rotated 180 degrees), or combinations of these.

A mutation in an intergenic region refers to a mutation located in a non-coding region of the nucleic acid molecule.

Genes comprising a deletion of less than a total codon will produce a frameshift mutation. This will result in a gene product that will be composed of amino acids that have no or little resemblance to the original (native) protein. Therefore, the protein will be dysfunctional. This will impact the role of that protein as well as possibly the stability of that protein because it will no longer be able to fold or assemble correctly. Hence the expression level for that protein will be reduced or eliminated compared to the wild type.

A deletion may result in a premature termination of expression of the gene product. Once again, the function and the stability of that protein will be affected. Further to this, the truncated mRNA transcript may be unstable and readily degraded. Hence the expression level of the mutated protein will be reduced or eliminated compared to the wild type.

The attenuated ts-19 strain comprises numerous deletions that affect surface proteins such as the outer membrane protein P95, P216, P146, P69 and lipoproteins. Membrane transport proteins are also affected by deletion mutations which will render these gene products dysfunctional. Hence if you compared the expression of these genes with the parent strain LKR, we would expect to see a marked difference in the expression levels of these proteins.

A mutation caused by a single base substitution that results in an in-frame amino acid change may alter the folding or assembly of that protein and hence while it may be synthesized; it may not function in a correct manner. Such a protein may also affect the expression of numerous other genes that may be under the control or effect of the mutated protein.

In one embodiment the presence of a mutation in at least one gene encoding a protein listed in Table 1 is detected by assaying for a change in expression of at least one protein. In one embodiment the change in expression is a reduction or absence of expression. Persons skilled in the art can readily appreciate methods for determining if the expression of a protein is changed or reduced, for example by quantitative antibody-based methods such as Western blotting, radioimmunoassay (RIAs) and enzyme linked immunosorbant assays (ELISAs) in which an antibody is used which detects and binds to the protein of interest. In addition since mRNA levels generally reflect the quantity of the protein encoded therefrom, quantitative nucleic acid methods may also be used to determine whether the *Mycoplasma* exhibits reduced or absence of expression of one or more proteins. For example quantitative reverse transcriptase/polymerase chain reaction (RT-PCR) methods may be used to measure the quantity of mRNA corresponding to a particular protein of interest. Numerous quantitative nucleic acid based methods are well known in the art. Also qualitative nucleic acid based methods (e.g. Northern Blot analysis) are well known in the art.

In one embodiment, as ts-19 comprises a mutated form of leucyl-tRNA synthetase and a deleted form of isoleucyl tRNA synthetase, which are both involved in protein synthesis, total protein synthesis may be altered in attenuated *Mycoplasma* compared to wild type *Mycoplasma*. Accordingly in one embodiment the method comprises assaying *Mycoplasma* bacteria for total protein synthesis.

With regard to "reduction in expression" the reduction compared to wild type may be at least about 5% compared to wild type. In other embodiments the reduction in expression is at least about 10%, 15%, 20%, 25%, 30%, 35%, 40%, 45%, 50%, 55%, 60%, 65%, 70%, 75%, 80%, 85%, 95% or 99%. In another embodiment the bacteria exhibits no expression of a protein expressed in the wild type bacteria and hence the percentage reduction in expression in 100%.

In one embodiment the presence of a mutation in at least one gene encoding a protein listed in Table 1 or in a nucleic acid molecule listed in any one or more of Tables 2 to 5 is detected by assaying at a genetic level. i.e. assaying nucleic acid. Such an assay may be a PCR assay.

Suitable types of PCR assay include conventional PCR, multiplex PCR, quantitative PCR (qPCR), real time PCR (RT-PCR), fluorescent capillary electophoresis (CE), high resolution melting curve (HRM) analysis, melting temperature (Tm) analysis, variable number tandem repeat (VNTR) and mutli locus sequence typing (MLST) and single nucleotide primer extension assay.

Analysis of conventional PCR products will be straightforward to persons skilled in the art and may include techniques such as nucleotide sequence analysis, restriction fragment length polymorphism (RFLP) analysis, denaturing gradient gel electrophoresis (DGGE) and single-stranded conformational polymorphism (SSCP) analysis.

PCR amplifications may be performed by selecting PCR primers that flank the region of the mutation(s). Each PCR primer set will preferably produce only a single band (amplicon). The size of the amplicon may be of a size appropriate to the method of PCR based analysis.

While in part the invention relates to changes between the DNA sequence of a *M. hyo* wild type strain and its temperature sensitive attenuated strain, the finding that these mutations are linked to attenuation is applicable to all species of *Mycoplasma* comprising the same genes due to conservation of these proteins across *Mycoplasma* species.

The method of the first and second aspects and the attenuated *Mycoplasma* bacteria of third aspect may relate to any *Mycoplasma* species.

In one embodiment, the attenuated bacteria are derived from animal-pathogenic *Mycoplasma* bacteria. As used herein, the term "animal-pathogenic *Mycoplasma* bacterium" means a bacterium that, in its wild-type, un-attenuated state, can infect and cause disease and/or illness in an animal. "Disease and/or illness in an animal" includes adverse physical manifestations in an animal as well as clinical signs of disease or infection indicated solely by histological, microscopic and/or molecular diagnostics. Animal-pathogenic *Mycoplasma* bacteria include human- and non-human-pathogenic *Mycoplasma* bacteria. Human-pathogenic *Mycoplasma* bacteria include, but are not limited to, e.g., bacteria of the *Mycoplasma* species *M. genitalium, M. fermentans, M. salivarium, M. hominis, M. pneumonia, M. incognitus, M. penetrans, M. pirum, M. faucium, M. lipophilum*, and *M. buccale*. Non-human-pathogenic *Mycoplasma* bacteria include, e.g., avian-, porcine-, ovine-, bovine-, caprine- or canine-pathogenic *Mycoplasma* bacteria. Avian-pathogenic *Mycoplasma* bacteria include, but are not limited to, e.g., bacteria of the *Mycoplasma* species *M. cloacale, M. gallinarum, M. gallisepticum, M. gallopavonis, M. glycophilum, M. iners, M. iowae, M. lipofaciens, M. meleagridis*, and *M. synoviae*. Porcine-pathogenic *Mycoplasma* bacteria include, but are not limited to, e.g., bacteria of the *Mycoplasma* species *M. flocculare, M. hyopneumoniae, M. hyorhinis*, and *M. hyosynoviae*. Ovine-, bovine-, caprine- or canine-pathogenic *Mycoplasma* bacteria include, but are not limited to, e.g., bacteria of the *Mycoplasma* species *M. capricolumn* subsp. *capricolum, M. capricolumn* subsp. *capripneumoniae, M. mycoides* subsp. *mycoides* LC, *M. mycoides* subsp. *capri, M. bovis, M. bovoculi, M. canis, M. californicum*, and *M. dispar*.

In the method of the second aspect an initial population of *Mycoplasma* bacteria are subjected to attenuating conditions.

According to this aspect of the invention, the "initial population of *Mycoplasma* bacteria" can be any quantity of *Mycoplasma* bacteria. The bacteria, in certain embodiments are wild-type bacteria. Alternatively, the bacteria may contain one or more mutations. In one embodiment bacteria in the initial population are clonally identical or substantially clonally identical; that is, the bacteria preferably are all derived from a single parental *Mycoplasma* bacterial cell and/or have identical or substantially identical genotypic and/or phenotypic characteristics.

As used herein, the term "attenuating conditions" means any condition or combination of conditions which has/have the potential for introducing one or more genetic changes (e.g., nucleotide mutations) into the genome of a *Mycoplasma* bacterium. Exemplary, non-limiting, attenuating conditions include, e.g., passaging bacteria in culture, transforming bacteria with a genome-insertable genetic element such as a transposon (e.g., a transposon that randomly inserts into the

*Mycoplasma* genome), exposing bacteria to one or more mutagens (e.g., chemical mutagens or ultraviolet light), site directed mutagenesis or deletions etc. When bacterial cells are attenuated by passaging in vitro, the cells may be passaged any number of times, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, or more times in vitro.

The initial population of *Mycoplasma* cells, after being subjected to attenuating conditions, are referred to herein as a putatively attenuated bacterial population. Individual clones of the putatively attenuated bacterial population can be obtained by standard microbiological techniques including, e.g., serially diluting the cells and plating out individual cells on appropriate media. Once obtained, the individual clones of the putatively attenuated bacterial population are assayed for the presence of a mutation in at least one gene encoding a protein listed in Table 1 or in a nucleic acid molecule listed in any one of Tables 2 to 5. Methods for determining whether an attenuated *Mycoplasma* bacterium comprises a mutation are described elsewhere herein. Exemplary methods include, e.g., RT-PCR-based methods, Western blot, etc.

Individual clones identified as comprising at least one of the required mutations can be tested for virulence by administration of the clones to an animal that is susceptible to infection by the wild-type (unattenuated) version of the bacterium. As used herein, "an animal that is susceptible to infection by a wild-type *Mycoplasma* bacterium" is an animal that shows at least one clinical symptom after being challenged with a wild-type *Mycoplasma* bacterium. Such symptoms are known to persons of ordinary skill in the art. For example, in the case of a putatively attenuated *M. hyo* strain that exhibits a mutation in each of the proteins listed in Table 1 and each of the mutations listed in Tables 2 to 5, the strain can be administered to pigs (which are normally susceptible to infection by wild-type *M. hyo*). Clinical symptoms of *M. hyo* infection of pigs include, e.g., acute respiratory symptoms, and reduced weight gain. Thus, if the putatively attenuated *M. hyo* strain, when administered to a pig, results in fewer and/or less severe symptoms as compared to a pig that has been infected with a wild-type *M. hyo* strain, then the putatively attenuated *M. hyo* strain is deemed to have "reduced virulence." Any degree of reduction in symptoms will identify the putatively attenuated strain as having reduced virulence. In certain embodiments, the putatively attenuated strain will be avirulent.

The attenuated *Mycoplasma* bacteria of the third aspect can be used in a live vaccine.

The term "in vitro serial passaging" refers to the practice of repeated passage of bacteria in media. It involves inoculating a broth medium with a live bacterial culture which is then given some time to incubate at the appropriate temperature. A portion of the incubated culture is then used to inoculate a fresh sterile culture which in turn is given some time to incubate. The cycle continues to achieve the desired number of passages. Each round of growth and re-inoculation is referred to as a single passage.

The immunogenic composition of the fourth aspect comprises the attenuated *Mycoplasma* bacteria of the third aspect. This immunogenic composition may be used with a suitable carrier in the vaccine of the fifth aspect.

A vaccine is a biological preparation that establishes or improves immunity to a particular disease. Vaccines can be prophylactic (e.g. to prevent or ameliorate the effects of a future infection by the pathogen), or therapeutic (e.g. to treat the infection). The vaccine of the fifth aspect is prophylactic for a disease caused by a *Mycoplasma* bacteria.

The appropriate carrier will be evident to those skilled in the art and will depend in large part upon the route of administration. The vaccine may further comprise one or more additional ingredients including, but not limited to, suspending, stabilizing, or dispersing agents. Still additional components that may be present in the vaccine are adjuvants, preservatives, chemical stabilizers, or other antigenic proteins. Typically, stabilizers, adjuvants, and preservatives are optimized to determine the best formulation for efficacy in the target animal. Suitable exemplary preservatives include chlorobutanol potassium sorbate, sorbic acid, sulfur dioxide, propyl gallate, the parabens, ethyl vanillin, glycerin, phenol, and parachlorophenol. Suitable stabilizing ingredients which may be used include, for example, casamino acids, sucrose, gelatin, phenol red, N-Z amine, monopotassium diphosphate, lactose, lactalbumin hydrolysate, and dried milk. A conventional adjuvant is used to attract leukocytes or enhance an immune response. Such adjuvants include, among others, MPL™ (3-O-deacylated monophosphoryl lipid A; RIBI ImmunoChem Research, Inc., Hamilton, Mont.), mineral oil and water, aluminum hydroxide, Amphigen, Avridine, L121/squalene, D-lactide-polylactide/glycoside, pluronic plyois, muramyl dipeptide, killed Bordetella, saponins, such as Quil A or Stimulon™ QS-21 (Aquila Biopharmaceuticals, Inc., Framingham, Mass.) and cholera toxin (either in a wild-type or mutant form, e.g., wherein the glutamic acid at amino acid position 29 is replaced by another amino acid, preferably a histidine, in accordance with International Patent Application No. PCT/US99/22520).

In one embodiment, the vaccine, if injected has little or no adverse or undesired reaction at the site of the injection, e.g., skin irritation, swelling, rash, necrosis, skin sensitization.

The sixth aspect relates to protecting against disease caused by *Mycoplasma*. The vaccine of the fifth aspect is prophylactic for a disease caused by *Mycoplasma*.

"Prophylaxis" or "prophylactic" or "preventative" therapy or "protecting against" as referred to herein includes keeping the infection from occurring or to hinder or defend from or protect from the occurrence or severity of a disease caused by *Mycoplasma*, including preventing, protecting or lessening the severity of a symptom or feature of the disease in a subject that may be predisposed to the disease, but has not yet been diagnosed as having it. It also includes reducing the period of infection or incidence of symptoms and reducing the size of any lesions.

"Prophylaxis" as used herein covers total prevention of the disease or a reduction in the extent or symptoms of the disease. It also refers to the reduction or inhibition of transmission of *Mycoplasma* or preventing the bacteria establishing in the host or protection against secondary infection with other *Mycoplasma* strains or other infectious agents.

The vaccine of the fifth aspect may be prepared for administration to animals in the form of for example, liquids, powders, aerosols, tablets, capsules, enteric coated tablets or capsules, or suppositories. Routes of administration include, without limitation, parenteral administration, intraperitoneal administration, intravenous administration, intramuscular administration, subcutaneous administration, intradermal administration, oral administration, topical administration, intranasal administration, intra-pulmonary administration, rectal administration, vaginal administration, and the like.

In an embodiment in relation to *Mycoplasma* bacteria which infect the respiratory tract, the vaccine is formulated for administration to the respiratory tract, for example by intranasal administration, aerosol administration or administration by inhalation by the mouth or nose. This route of administration is preferred because the nature of protective immunity for *M. hyopneumoniae* may be local (pulmonary) immunity and cell-mediated immunity in preventing the disease rather than from circulating antibodies. Presentation of the vaccine to the respiratory tract may stimulate a local immune response. Therefore localised administration of the vaccine may be more effective. Furthermore by administering the vaccine in an enclosed barn or space (coarse spray mass administration) and allowing the pigs to inhale it, reduces the labour involved in vaccinating large numbers of animals. Aerosol vaccination (or spray vaccination) is currently used on a commercial basis to effectively vaccinate poultry against certain diseases and is also suitable for vaccinating pigs.

Intranasal administration covers any administration via the nasal passages or snout. The vaccine may be applied to the nasal cavity as a solution, suspension or dry powder. Solutions and suspensions may be administered intranasally using, for example, a pipette, a dropper or a spray, optionally an aerosol spray. Dry powders may be administered intranasally by inhalation.

Aerosol administration refers to administration of the vaccine in as a suspension of fine solid particles or liquid droplets in a gas.

Inhalation (also known as inspiration) is the movement of air from the external environment, through the air ways, and into the alveoli in the lungs.

An effective dose of vaccine to be employed therapeutically will depend, for example, upon the therapeutic objectives, the route of administration, and the condition of the animal.

Dosage levels for the vaccine will usually be of the order of about $10^3$ to $10^8$ colour changing units (CCU) per mL per dose, and preferably about $10^4$ to $10^7$ CCU per mL per dose.

It will be understood, however, that the specific dose level for any particular porcine animal will depend upon a variety of factors including the activity of the specific compound employed, the age, body weight, general health, sex, diet, time of administration and route of administration.

Selection and upward or downward adjustment of the effective dose is within the skill of the art.

Information about mutations in *Mycoplasma* bacteria that render a strain attenuated allow determination of whether an animal is infected with an attenuated or virulent *Mycoplasma* strain.

Wild type field strains infect animals and if they are virulent strains then they can cause disease in their own right or they can pave the way for secondary bacterial and/or viral infections.

Following infection, both the vaccine strain and any wild type *Mycoplasma* strain (through infection via natural exposure) can be recovered from the animal. Detection can be made by PCR. The organism can be extracted directly from infected tissues (e.g. from lung or trachea) and undergo detection by PCR. The organism recovered from the animal may be cultured in vitro first to allow the organism to grow so that more copies of the organism are present to increase effectiveness of detection methods (e.g. by PCR or via biochemical or serological methods for identification).

With respect to analysing outbreaks of infection, the method of the ninth aspect could determine whether or not the outbreak was due to a vaccine strain. That is, if an animal has been vaccinated with a *Mycoplasma* vaccine and soon develops disease, the subject can be tested to determine if it is vaccine or whether it is a wild type virulent field strain that is responsible for the infection. This is particularly important in a farm setting.

The ninth and tenth aspects provide kits comprising primers or probes for detecting mutations related to attenuation.

In one embodiment the primers are MHP-2F (SEQ ID NO:1) and MHP-2R (SEQ ID NO:2).

In another embodiment the primers are MHP-9/10-2F (SEQ ID NO:3) and MHP-9/10-2R (SEQ ID NO:4).

In one embodiment the kit comprises oligonucleotide probes that hybridise with the mutated gene or nucleic acid molecule. The probes may be labeled with a radioactive or non-radioactive labeling agent, the latter comprises conventional biotin, Dig (digoxigenin), FRET (fluorescence resonance energy transfer) or fluorescent dye (Cy5 or Cy3). Further, the oligonucleotides can be used as primers for PCR amplification. In this case, the kit may contain DNA polymerase, 4 dNTPs and PCR buffer for PCR reaction. In addition, the oligonucleotides can be attached to a microarray as probes. In this case, the kit may contain hybridization reaction buffer, PCR kit containing primers for amplifying a target gene, washing solution for the unhybridized DNA, dyes, washing solution for unbound dyes and manual sheet for the microarray.

In one embodiment, the probes may be a combination of more than one probe capable of simultaneously detecting more than one mutation from a single sample. Practically, the probes are optimized to simultaneously hybridize with multiple target mutation DNAs of *Mycoplasma* under the same hybridization and washing conditions.

In one embodiment the kit provides a microarray comprising a set of probes for detecting one or more mutations, which can simultaneously detect many mutations from a single sample with a single experiment.

Throughout this specification, unless the context requires otherwise, the word "comprise", or variations such as "comprises" or "comprising", will be understood to imply the inclusion of a stated element or integer or group of elements or integers but not the exclusion of any other element or integer or group of elements or integers.

It must also be noted that, as used in the subject specification, the singular forms "a", "an" and "the" include plural aspects unless the context clearly dictates otherwise.

It will be apparent to the person skilled in the art that while the invention has been described in some detail for the purposes of clarity and understanding, various modifications and alterations to the embodiments and methods described herein may be made without departing from the scope of the inventive concept disclosed in this specification.

All references, including any patents or patent applications, cited in this specification are hereby incorporated by reference. It will be clearly understood that, although a number of prior art publications are referred to herein, this reference does not constitute an admission that any of these documents forms part of the common general knowledge in the art.

BRIEF DESCRIPTION OF FIGURES

FIG. 1A-C show the exact nature and location of mutations in the *M. hyo* ts-19 vaccine strain (master and P12) compared to the *M. hyo* J strain deposited as NC_007295.1 (SEQ ID NO:5) and the *M. hyo* LKR strain.

FIGS. 4A and B show high resolution melting (HRM) profile of genome target MHP9/10 in the normalized graph mode for Vaxsafe® MHP vaccine strain, parent strain and a mixture of these two strains. (B) Difference graph where the vaccine strain has been normalized such that any deviations from the vaccine strain can be observed.

Figure 2:
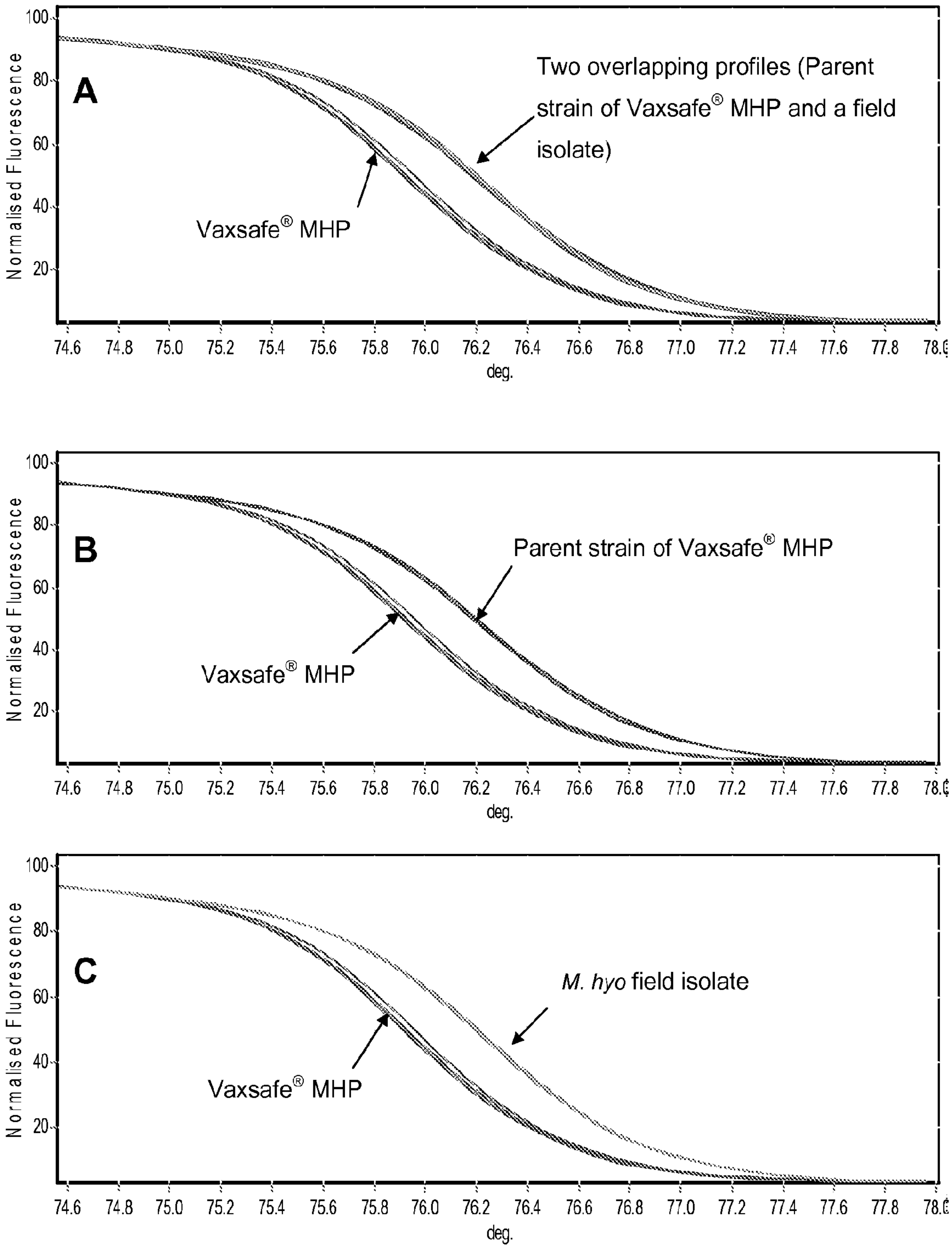
FIG. 2A-D show the high resolution melting (HRM) profile of genome target MHP2 in the normalized graph mode. (A) HRM of Vaxsafe® MHP strain, the parent strain of Vaxsafe®MHP and a field isolated strain of *M. hyo* (B) HRM of Vaxsafe® MHP strain and the parent strain of Vaxsafe® MHP (C) HRM of Vaxsafe® MHP strain and a field isolate strain (D) Difference graph where the wild-type strains have been normalized such that any deviations from the wild-type can be observed.
Figure 2:
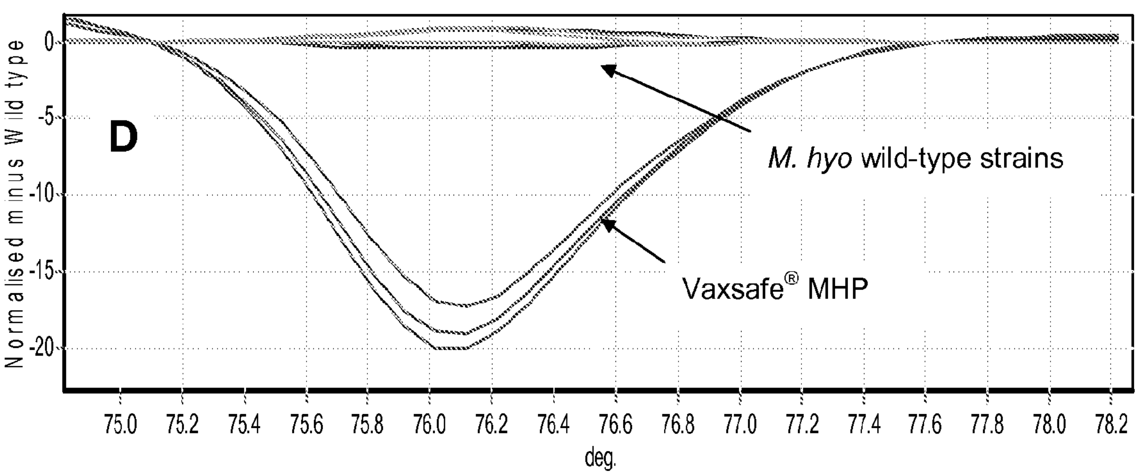

The invention is now further described in detail by reference to the following example. The example is provided for purposes of illustration only, and is not intended to be limiting unless otherwise specified. Thus, the invention encompasses any and all variations which become evident as a result of the teaching provided herein.

Example 1

Preparation of Vaccine Strain

Australian *Mycoplasma hyopneumoniae* isolate LKR is an abattoir specimen of pig lung exhibiting typical enzootic pneumonia disease (Lloyd and Etheridge (1981), J. Comp. Path. 91:77-83). The isolate was cultured and stored at the *Mycoplasma* reference culture collection at the University of Adelaide, South Australia. A culture of this isolate was subsequently obtained by the *Mycoplasma* group at the University of Melbourne, Victoria.

The culture was in vitro passaged three times before being subjected to mutagenesis using N-Methyl-N'-nitro-N-nitrosoguanidine (NTG) at 200 mg/mL using a method described previously (Nonamura and Imada (1982) Avian Diseases 26:763-775). Briefly, a culture of *M. hyopneumoniae* strain LKR was growth to late log phase and pelleted by centrifugation. The cells were washed in phosphate buffered saline (PBS) and exposed to NTG. The cells were pelleted and resuspended in modified Friis media (Friis, N. F. 1975) and incubated at 33° C. for 4 h. The culture was then passed through a 0.45 μm filter, appropriate dilutions made and aliquots placed onto agar plates and incubated at 33° C. Colonies that had grown were cloned into 3 mL of broth and incubated at 33° C. Ampoules of the clones were stored at −70° C. and the temperature sensitivity of each clone determined.

The temperature sensitivity of ts-19 was determined by performing a duplicate titration and incubation at 33° C. and 39.5° C. The titre is typically $>1\times10^8$ CCU/mL at 33° C. and $<1\times10^2$ CCU/mL at 39.5° C.

The ts-19 strain was deposited under the Budapest Treaty as NM 04/41259. It is used in Vaxsafe® MHP, a live attenuated temperature sensitive vaccine for protection against *M. hyopneumoniae* infection in pigs.

Example 2

Sequencing and Analysis

Whole genome sequencing for three *M. hyopneumoniae* strains (vaccine strains ts-19 Master, ts-19 P12 and the parental strain LKR) was performed. Sequencing was conducted by utilizing 454 sequencing technology (Roche). A minimum of 15× coverage per read was performed for each of the three genomes sequenced. For each separate genome, a consensus sequence was deduced from each set of reads. Overlapping reads for each genome were aligned into several large contigs. The contigs derived from the vaccine strain were determined through sequence alignment to have a high homology to the *M. hyopneumoniae* J strain sequence (NC_007295.1 (SEQ ID NO:5)).

The large contigs from each strain were then aligned against the J strain sequence and the gaps within the ts-19 or LRK sequences were subsequently identified. Several PCR primers spanning the gaps were designed and synthesised. The primer sequences were based on a combination of sequence generated from the vaccine or LKR strain or from the sequence of the J strain available on the nucleotide database (GENBANK, NC_007295.1 (SEQ ID NO:5)). The primers were used to amplify by PCR the target regions. The PCR amplicons were then sequenced. The sequences generated from overlapping reads spanning the gap regions were then aligned into a contig until the gaps were bridged and the whole genome sequence was subsequently completed.

Once the whole genome sequences of ts-19 (Master and P12) as well as the parental strain LKR was completed, the three sequences were then aligned against the full genome of J strain in a multiple sequence alignment.

From the multiple sequence alignment, nucleotide bases that were substituted, deleted or inserted from both the ts-19 Master and the P12 genomes when compared with both the sequences of the LKR and the J strain were identified as mutations. These mutations were categorized as changes within known genes, hypothetical genes, intergenic or non-coding regions. The proteins encoded by the mutated genes are listed in Table 1. Further mutations are listed in Tables 2 to 5. The exact nature and location of the mutations is show in FIG. 1.

Example 3

Selecting for Novel Attenuated *Mycoplasma*

Selection of a novel *Mycoplasma hyopneumoniae* or other *Mycoplasma* sp vaccine candidate(s) may be made by screening clones for one or more genes which have been mutated in ts-19.

Following mutagenesis and ts selection, a ts *Mycoplasma* clone would be grown in culture and the organism subjected to mRNA extraction using standard methods. The mRNA will be converted to cDNA using reverse transcriptase. The parent strain will also be grown in culture and the organism subjected to mRNA extraction. The mRNA will be converted to cDNA.

The cDNA from each of the ts clone and the parent strain will be used in separate PCR reactions targeting one or more of the mutated genes identified in ts-19. The resulting PCR amplicon(s) will be printed onto microarray slides. Two slides will be prepared encompassing the array of ts clone PCR products and two other slides will be prepared to encompass the array of parent PCR products.

The whole genome cDNA from the ts clone will then be coupled to a Cy Dye Ester (e.g. Cy3) and the whole genome cDNA from the parent will be coupled to another Cy Dye Ester (e.g. Cy4).

The Cy3 labelled cDNA will be hybridized to each of the microarray slides (one ts clone and one parent). Similarly the Cy4 labelled cDNA will be hybridized to each of the microarray slides (one ts clone and one parent).

Differential expression will analysed based on hybridization signal strength and colour which will be reflective of gene expression levels.

Example 4

Distinguishing Between Ts-19 and Other *M. hyo* in the Field

A field sample (e.g. nasal swab or lung tissue retrieved from the infected pig) will be subjected to PCR amplification using a specific set of primer(s). Each primer set will be designed to flank a different site of mutation identified to be unique to ts-19 vaccine strain. The PCR amplicon can be analysed by mutation detection techniques such as:

Fluorescent Capillary Electrophoresis (CE):

For deletion and insertion mutations, fluorescent CE would be a suitable mutation detection technique to employ. In this case the PCR primers would each be labelled with a different fluorophore and used in a PCR reaction. The field sample (test) as well as a ts-19 sample (positive control) will undergo PCR amplification. The PCR products generated from the field test sample and the positive control (ts-19) would be subjected to capillary electrophoresis whereby the separation of PCR product is based on size. CE can identify changes in amplicon size resulting from a single (or multiple) nucleotide base deletion or insertion. Therefore a PCR amplicon from the vaccine strain would have a known peak position which will be different to the PCR amplicon generated from the field sample. If both the ts-19 vaccine and a field strain are present in the sample, then two distinct peaks will be observed.

Single Strand Conformation Polymorphism (SSCP):

Single-strand conformation polymorphism (SSCP) analysis is a sensitive technique for mutation detection. The principle of SSCP analysis is based on the fact that single-stranded DNA has a defined conformation. Altered conformation due to a single base change in the sequence can cause single-stranded DNA to migrate differently under non-denaturing electrophoresis conditions. Therefore, PCR from the ts-19 vaccine strain (positive control) and that of the field test sample(s) will display different banding patterns.

SSCP can be applied for base changes, deletions and insertions. One or more mutation regions can be PCR amplified using radioactively labelled primer (e.g. labelled with $P^{33}$). A ts-19 positive control amplicon sample is assayed in an identical manner to the field test sample. The double stranded DNA amplicons undergo denaturing (i.e. exposure to heat and alkaline) will result in the formation of single stranded DNA molecules which are immediately subjected to electrophoresis separation under non-denaturing conditions. Following electrophoresis, the gel will be dried onto filter paper (e.g. Whatmann) and then exposed to autoradiographic film. Following development of the autoradiograph the banding patterns from the field sample will be compared with that of the ts-19 positive control sample. An identical banding pattern to the ts-19 pattern will indicate that the sample is ts-19 vaccine strain. A different banding pattern will indicate that the sample is not ts-19.

The SSCP method may also be applied in a non-radioactive format.

High Resolution Melt (HRM) Curve Analysis:

HRM curve analysis will be applicable for mutations involving base substitutions, deletions and insertions. In this case the field test sample as well as a ts-19 positive control sample will be subjected to real time (RT) PCR amplification of a unique (mutation containing) region using a cycle sequencer. The PCR machine used will be one capable of performing HRM curve analysis. At the completion of the PCR amplification cycle the PCR amplicon will be subjected to a HRM curve analysis conducted by the PCR machine. The ts-19 amplicon will display a distinguished melt curve display compared to the field strain amplicon.

Example 5

HRM Analysis for Vaxsafe® MHP

Based on the mutation data from Example 2 two examples of high resolution melt curve (HRM) assays have been developed that are capable of distinguishing between Vaxsafe® MHP vaccine strain and other *M. hyo* strains including the vaccine parental strain. However, any of the mutational changes present within the vaccine strain can be used as targets for HRM analysis.

Two regions within the vaccine genome were chosen as an example for HRM analysis. These regions are designated MHP2 and MHP9/10. MHP2 is an example of HRM targeting a single mutation (FIGS. 1B and C mutation number 2). MHP9/10 is an example of HRM targeting two mutations (FIGS. 1B and C mutation numbers 9 and 10). The Qiagen "Rotor Gene Q" unit with 2 or 5 Plex and HRM capability was used in this work in conjunction with the Type-It® HRM™ kit. In brief, HRM is a post-PCR technique which can be used for mutation scanning and genotyping. The method does not require post-PCR handling and hence minimises the risk of cross-contamination. Furthermore, there is no separation step involved and this reduces analysis time.

HMR analysis is conducted on DNA samples such as clinical samples (eg. swabs or tissue preparations) cultured for *M. hyopneumoniae* in selective broth media to minimise growth of contaminating organisms. The DNA is then extracted from cultured *M. hyo* samples. The purified DNA is normalized for all test samples.

Example 5a

Target MHP2

The primer sets (MHP-2F and MHP-2R) were chosen to amplify a 151 bp region of the *M. hyopneumoniae* genome.

| Primer Name | Sequence (5'→3') | Amplicon Size (bp) |
|---|---|---|
| MHP-2F | GAC AAG GAA CCA AGC GTT TC (SEQ ID NO: 1) | 151 |
| MHP-2R | CAG GCT CTT GCA TTT TAC AGT C (SEQ ID NO: 2) | |

PCR Reaction

The HRM reactions are conducted in triplicate. Each reaction contains the following:

| | |
|---|---|
| HRM PCR Super Mix (2x) | 12.5 μl |
| Nuclease free water | 9.75 μl |
| Forward Primer (10 pmol/μL) | 0.9 μl |
| Reverse Primer (10 pmol/μL) | 0.9 μl |
| DNA template (70 pg/μL) | 1 μl |

Dispense the required reagents (see above) into a 0.1 mL PCR tubes and subject to thermal cycling.

Thermal Cycling Conditions:

| Cycle | Cycle Point |
| --- | --- |
| Hold @ 95° C., 5 min 0 secs | |
| Cycling (40 repeats) | Step 1 @ 95° C., hold 10 secs<br>Step 2 @ 55° C., hold 30 secs<br>Step 3 @ 72° C., hold 10 secs, acquiring to Cycling A([Green][1][1]) |
| Melt (68-87° C.), hold secs on the 1st step, hold 2 secs on next steps, Melt A([HRM][7][1]) | HRM Analysis, data acquisition every 0.1° C. |

Results

HRM analysis was performed on DNA extracted from pure cultures of either the vaccine or other *M. hyo* strains. Individual reactions were performed on either DNA from each strain or on mixture of DNA from different strains.

The HRM profiles of target MHP2 for Vaxsafe© MHP vaccine strain and two wild-type *M. hyo* (vaccine parent strain and a field isolated strain) are shown in FIGS. 2 (A, B and C). The HRM exhibited a melting pattern that started its separation at approximately 75.2° C. and ended at approximately 77.4° C. The vaccine strain showed a lower temperature melting profile, resulting in its separation from both wild type strains (the parent strain of Vaxsafe® MHP and the field isolated strain). The wild-type strains maintained a higher level of fluorescence for a longer period of time than the vaccine strain resulting in a melting profile that is shifted to the right. This shift can be used to distinguish between the vaccine strain and other *M. hyo* wild-type strains.

The HRM profiles of the two *M. hyo* wild-type strains were identical as shown by their overlapping profiles (FIG. 2A). The overlapped profiles are shown separately in FIGS. 2B and C. FIG. 2D displays the same data using a "difference graph" which shows a clear separation between the vaccine strain and the wild type strains. The difference graph is created by defining the vaccine strain as the reference. The fluorescence levels of the wild-type strains are then normalized to ~zero and any deviations from the wild-type standard are recorded in the difference graph.

Example 5b

Target MHP9/10

The primer sets (MHP-9/10-2F and MHP-9/10-2R) were chosen to amplify a 160 bp region of the *M. hyopneumoniae* genome.

| Primer Name | Sequence (5'→3') | Amplicon Size (bp) |
| --- | --- | --- |
| MHP-9/10-2F | TGT CAA GAA CAT AAG ATG GAG TTC A (SEQ ID NO: 3) | 160 |
| MHP-9/10-2R | ATT GTC GAA TCC CCT AAT AAA AT (SEQ ID NO: 4) | |

PCR Reaction

The HRM reactions are conducted in triplicate. Each reaction contains the following:

| | |
| --- | --- |
| HRM PCR Super Mix (2x) | 12.5 µl |
| Nuclease free water | 9.75 µl |
| Forward Primer (10 pmol/µL) | 0.9 µl |

-continued

| | |
| --- | --- |
| Reverse Primer (10 pmol/µL) | 0.9 µl |
| DNA template (70 pg/µL) | 1 µl |

Dispense the required reagents (see above) into a 0.1 mL PCR tubes and subject to thermal cycling.

Thermal Cycling Conditions:

| Cycle | Cycle Point |
| --- | --- |
| Hold @ 95° C., 5 min 0 secs | |
| Cycling (40 repeats) | Step 1 @ 95° C., hold 10 secs<br>Step 2 @ 55° C., hold 30 secs<br>Step 3 @ 72° C., hold 10 secs, acquiring to Cycling A([Green][1][1]) |
| Melt (68-87° C.), hold secs on the 1st step, hold 2 secs on next steps, Melt A([HRM][7][1]) | HRM Analysis, data acquisition every 0.1° C. |

Figure 3:
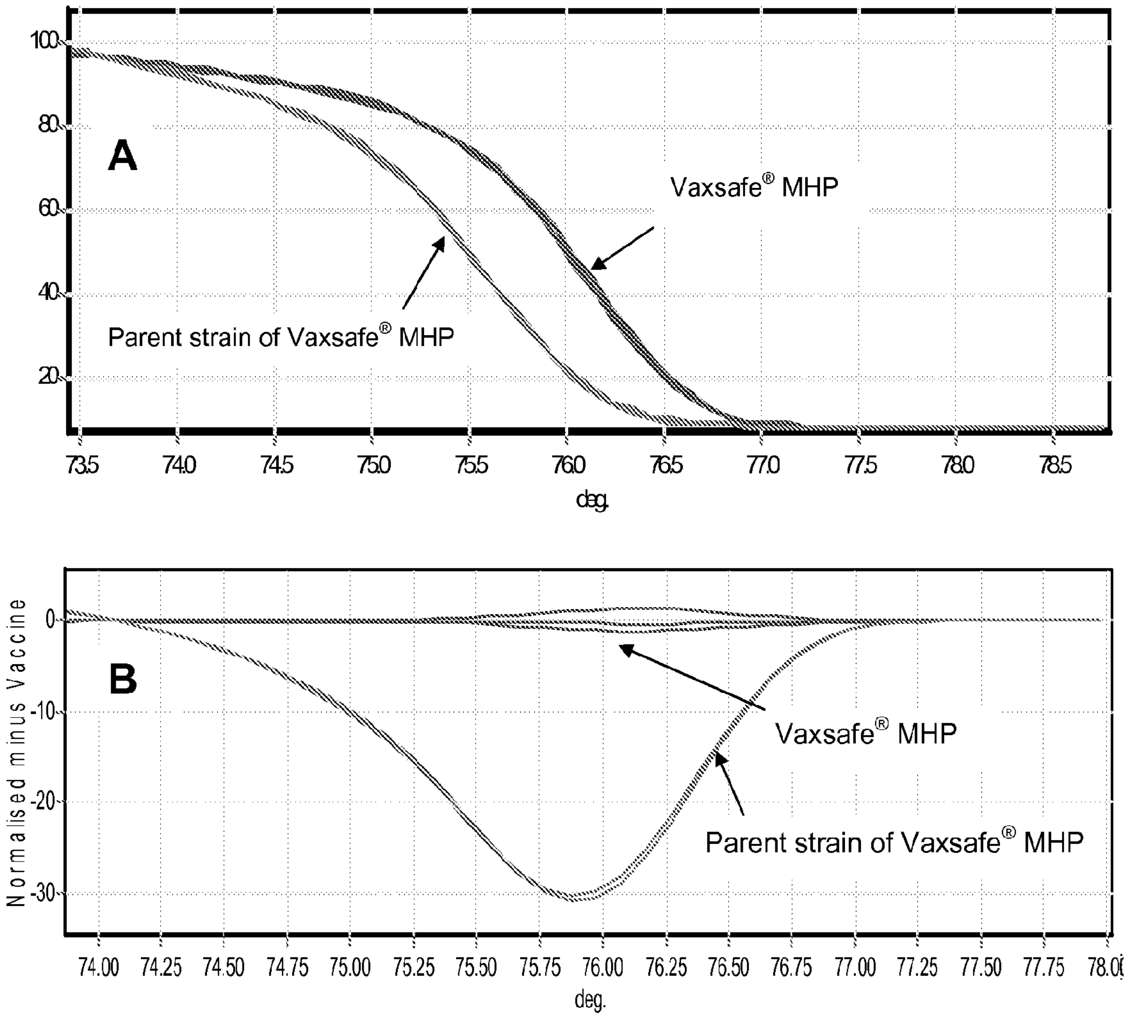
FIGS. 3A and B show the high resolution melting (HRM) profile of genome target MHP9/10 in the normalized graph mode for Vaxsafe® MHP vaccine strain and parent strain. (B) Difference graph where the vaccine strain has been normalized such that any deviation from the vaccine can be observed.

The HRM profiles of target MHP9/10 for Vaxsafe MHP vaccine strain and the parent strain are shown in FIG. 3A. The HRM exhibited a melting pattern that commenced separation at approximately 73.7° C. and ended at approximately 77.0° C. The vaccine strain showed a higher temperature melting profile, resulting in its differentiation from the parent strain. The vaccine strain maintained a higher level of fluorescence for a longer period of time than the parent strain resulting in a melting profile that is shifted to the right. This shift can be used to distinguish between the vaccine strain and the parent strain. FIG. 3B displays the same data using a "difference graph" which shows a clear separation between the vaccine strain and the parent strain.

DNA from both Vaxsafe® MHP vaccine strain and a parent *M. hyo* strain LKR were mixed on a ratio of 1:1 and subjected to HRM analysis for target MHP9/10. In the same analysis individual DNA from each strain was also subjected to HRM analysis. The profiles (FIG. 4A) exhibited the same melting pattern as described above for target MHP9/10 allowing the distinction between the vaccine strain and the parent strain. The HRM profiles of the mixed *M. hyo* DNA (vaccine and parent strains) shown in FIG. 4 (A) exhibited a melting pattern which is different from both the DNA of the individual vaccine and parent strains. In the difference graph (FIG. 4B) the vaccine strain has been normalized such that any deviations from the vaccine can be observed. In the difference graphs the vaccine can be distinguished from the wild type strain but the mixture sample exhibited a totally different melting profile to both the wild type and vaccine strain (FIG. 4B).

CONCLUSIONS

Two examples were chosen to demonstrate that HRM curve analysis can be used as a tool to differentiate between Vaxsafe® MHP vaccine strain and other *M. hyo* wild-type strains including the vaccine parent strain. Example 5a demonstrated differentiation based on a single nucleotide base. Example 5b demonstrated differentiation based on two nucleotide base changes. HRM analysis can subsequently be used to target any of the numerous mutational changes present in the vaccine strain as a means for differentiation of infected from vaccinated animals (DIVA). A single HRM analysis can target either a single or multiple mutations. For each mutation(s) the forward primer can be designed anywhere within a 500 bp region upstream of the mutation site(s). The reverse primer can be designed anywhere within a 500 bp region downstream of the mutation site(s). Preferably the resulting amplicon should be between 50-200 bp in size.

SEQUENCE LISTING (5 sequences)

SEQ ID NO: 1 - DNA, 20 bp, Artificial Sequence
  Synthetic primer
gacaaggaaccaagcgtttc

SEQ ID NO: 2 - DNA, 22 bp, Artificial Sequence
  Synthetic primer
caggctcttgcattttacagtc

SEQ ID NO: 3 - DNA, 25 bp, Artificial Sequence
  Synthetic primer
tgtcaagaacataagatggagttca

SEQ ID NO: 4 - DNA, 23 bp, Artificial Sequence
  Synthetic primer
attgtcgaatcccctaataaaat

SEQ ID NO: 5 - DNA, 897405 bp, Mycoplasma hyopneumoniae
tttttctcctttttttgcttaaatttaagttttagaagttattttaagggattttaaaaaaatattgttaaaatttaaaaccaaaatcaactttattaaatgtgctaaataaagttgataaaatgtttgcaaaaacatttttgttgttttaaacaaaacaaattgatttaaaaattatactacaaaattaaaggaaaatttataaaatgcaaacaaataaaaataatttaaaggttagaacacagcaaattagacaacaaattgaaaatttattaaatgatcgaatgttgtataacaacttttttagcacaatttatgtactcaacgagacagaaactgaaattattatagattttacagacttaatcgcgaaacaggaagtgatttcacgctgagttgatacggttgaaaaagctattaaaaatcttgaaatttcaaaaatcctaacttttaacaatacaaataattataccattaattcaaaagaaagccaaaacttttccataaaaaataaatattgcagctttaatattaacaatgttttaaacaaatttacctttagaaactttataaaatcaagttataatttccaaatttttagtatttatgacgcaatagtcgcaaattcaagactaaattactcaccaatttttatttcaggaccatcaggaattggaaaaacgcattttattaatgcgatcggaaatttacttgtagaaaaacagaagaaagttttctacattaacgactataaatttatcagttgcgtttcttcctggatgcaaaatggtcaaaatgaaaaaattagtgaatttttaaactgattgtctcaagttgacgcttttctttttgatgatatccaaggtttggctaacaaacaacaaacttcaattgttgcacttgaaattttaaatagatttatcgaagaggataaaacagtgataataacatctgataaatcgccttctttacttggtggatttgaagaaagatttataacgcgatttagttcagggttgcacattaaattaaacaagccgaaaaaagaagactttttgcggatttttaaacataaattagttgaagaaaaattagaaaaacatatttgaacaaatgatgcttttgaatttttgtcaaagcattttcgaaattcgattcgtgagcttgaaggtgcgctaaaatcaattgttttttatatccaaacaaataaaaataaatttgagaatgaaatttattttgataagaaaaaaatgtttgaaatttttgttgaaaaatatgaaatcgaacaaacaattacccctgatttaatcattgaggttgtctcaaaatattatggcgtctcaattttagatataaaaagtgaaaaaagaggcaaaaatattgtgcatgcccgcgatattgcaatctgattaattaaaaatattctggatttaactcataatagcgtaggaactttttttaacaacagaagacattcgacaataatttctacccttaaaaaaattgataccttaaaacaaagcaacaataatgaacttgaaattgcacttaaccacatttataaacaattaaactgaagttttaaacagcgaaaataaaaatattaaacagcattttggacaaaaagtactataaattaaagtggttttctattttttctacatttctacagccttattatttttattattaaaactaaataaaaattaaccaaatataatataattattagaggtaaaaatatgaaatttacaattgaaaaaaaaattattgaatgacaaattgaaagaatgcaatcagcaattctaaataatataaattcaccattaagttcgttttttttaaaacttacaagaagcggattatttataatttcaacaaacagtgagctttcttataaagtttttattaataaaaaagatttaattgaaattcatgatgttggaagttgcttaattgacggtgtttttttacgtgatgttattagaaaaagtgataaacaattaagttttcatctaattggttctgaattaaaagttttttgggaagatgctcttttttcaaagacaactcgggattcttctttttttccagaaattaactttgagcaaaaaggaattaaattaactgtaaatgctaaaaattttaaaagagcgataaaaaatacagcttttgcaacaacaaataatccttcacagccgattttatcggcaataaatcttagatctgaagccggttttctacatttttcggcaacagatacatctcgatttgcctcagaaaaaatcgaaatttcgaataaaagtagaataaatatttctgttagcgcgaaaaatttaaaagattttatcccacctgaacttgataaggatatcgaattaaatattgaatcttcaaaaattagttatatttacgataatttaacaatccagtcgcgaattttcactattgaatacaaggatatttcaaatatcctaccaaaagacagcgaaattttatactcacttacaatcaacaaacgcgacatcctcgatctgattgataaaacaacaataattacccccggaaaagataatgttattaacctttcgttgtcaaaaaatgcgttaaaaggctatatttctcaatatgattcgggtcagtcgaatgttcagacaaaaaatgttcttgatttcagatttaacccaagatttgcatcagattttcgattcgaccctgaattagctcaggttaatataaattatcgctatttaaaagatgcaatttctgtttttgataaagtaattgatattcacattaatgaaaaaatgaacaaaatgttgatagtttcaccagaaaaaccagaaatttgtcagttagtcggtcttgttttagtctaaattttctctaaaatttagactattttttttgattaatatttaaaaaaaataagctattttatagtataatttaaaaaaagaaactaatttgaggaaatttttaatgtcaaaaaaatctaaaaattcaagcattgaatttgatgctattgttgtcggtggcggccatgctgggatcgaagcagtttatgcattattaaaaaaaaagttaaaagttgttctaataactcttgataagaaaaaattagcttcaatgccttgtaatcccgcaattggtgggccagcaaaaggaattataactcgcgagatcgatgcccttggaggagttcagggaaaattttcagatttagcaatgatccaaattaaatatttaaatgaatcaaaaggtcctgccgttttagcaattagagcccaaattgataaggaaaaatattcaaaattaatattaaaggatttgaaaaaacaggaaaatttattaattatcgaggatttggttagtgaacttctagttgaaaaaaatcgtgtttttgggctaaaaacagcgaaaaaacaagtgtttttttcaaaaaccgtgattattacaacaggtacctacatggattcaaaagttcttcgaggctcattagcgattccaagtgggcctgatggtcaacaaacttcaaatttgctttcaaataatttaaaaaggcttggttttgaacttcaaaggttaaaaactggaactcccccgcgaatttttacttcttcaattgacttttcaaaagttgaaaaagaggttttgcctgtttataatataaatttttctttccaatcaaagcataagataaaaaaacaaatttcttgttatttgacttatacaacagcaaaaactcatgatataattaacaaaaatttaggaaaatcctcgatgtattcaggtctaatttccggtgttggaccacgttattgtccttcgattgaagataaaattgttcgcttttcagaaaaacctcgccaccaaatatttttcgaaccagaaacaaaaaaacaagatataatgtatattaatggcctttcaacgtcgatgcccgaggatgttcagcttgaaatggttaaaacaattcctggtctggaaaatgcaaaaattgcaaaattcggttatgcgattgaatatgatgccctaaatccgcttgaattgaaaaaaagtttggaaactaaaaaagttaaaggactttttatggcaggtcaaatcaatggaacaagcggatatgaagaagccgcggctcaaggtttagtcgccggaattaatgcgggccaatttgtgcttgggaaaaaaccagtcgaaattttaagaaatgatggttatatcggcgttttaattgatgatttagtcactaaaggaacaaaagaaccttatcgtatgctgacttcacgtgcagaatatcggcttattttaagaaatgataatgccgatattcgaatggcaaaatatgctttaaaatcagggctgatctccaaaaaagagtatttgaaaatcaaagcaaagtatgcaaaaattgacaggaaaattttagaactttctaaagaatttgtttccccaaaagatgaattagcaaaaaaatataatttggagaagcgaatttccaagttaaaattaatttcctgaccaaatgttaactttaaagatattctccctgattttgaattcggatatgaattaactgtgatggcccggctaaaaggttatattcaaaaacaaaattctgaagcccaaaagatgattcgactggaaaaattactgattccaggcgatctaaattatgaaaaagtcgcaaatttgtcatcagaagctcttgataagtttcaaaaagttagaccaaaaacaattggggaagcaagtagaattagtggtgtaaatcctgctgatatccagatgcttttgtttcatattaaagttttaaaaatgcaaaaagtctctaaaatttaatgaaaatttcaataataagttttggttctagccccagagaatgattaggtttatacaaaaaagaaattaataaaatcaaacagtttaaatatcaaatcgaatttatcaacctttctgagcattcccaagaaaatatagagcttaaaaaaatgcttgaaacaaaggatattttgcaaaaaattcctaaaaattcatcttgttatctttttacagaaaggggaaaaacagtaacgagtaaagaattttcccaacttttgaatttctcgaatatttgttttataattgggggttcgtacggcgttgatgaaaaattaattgcaaaatcaaggccagatattggttttttatcatttggaaagctaacttttgcccataaaatttttaagcttatcgttttagagcaaatttaccgtggtttttcgattaaatttaatcgaaaataccaccacgccgattaaaaaaagaggtaaaatgaaaagaaaaaattatgaaaaaataattcaaaacattgaaaatcatgataatatttttatctttcatcacatcagaccagatggagattgtctgggtgcccaacaaggttttggttatgcgatcgcaaaaagattccctaaaaagaaggttttttttattggggataatgaaaatatttttaattttttaaattttcattttgataatgaaaatttaattcaagatgaattttttcaaaattcacttgcaattacagtcgatactgctgatattaaaagaatcaaaaaattagatttttttctaaattcaaattttaaaacacgaatcaaaattgaccatcaccctgatatttttgaggaaatttataacgaaaaatgggttgatccaactttttcggctgcttcagagatgatagggtacctactaatggaagaaaattgggaaattaatagtgaaatttccaaatttatatatttaggaattctaactgattcaggccgttttttatttccttcaacaacctcaagaacatttcaggttgctgcttttttgatgaaatttaattttgattttgcaaaattaaattgatttttgtcgaatagaacagaacaagaagtcgctttttgtgctgaagttttagcaaattataaaaaaaaagataaggttttatggtattttgtctcaaaagagatacaaaataaattcaaattaagaaacgatcagttatcagccgttaatattttggcaaacattggcgatgcccgaatttgactatttttgattgaaatggagaatggaatccgtgttagaatacgttcaaatggtccaaaagttaatgaaattgcttctgaatacggaggtgggggccatgagtatgcagcaggtattaatctagaaaagtcagaaaaaactaaggaaatttcgcaggaaattatcgagaaattagttattcaagtaaaggaatttgaacaaaatgagtaatattaagataaaagaaattataaaacttatcgaaaatcacgatacaattgtaatttttcaccatatcagaccagacggggattgtattggcgcacaattagggcttaaaaatttaattttagataattttaaaaataaaaaagtttttgcagttggcaatcacaaaggatcattttcatttttgaatgcaaaaacagattcaattcccgataagctaattttaaaaaattctttggcgataattgttgatgcaaattttaaaaatcgaattgaatctgtttttttatttgatcaatttaaatttaaaacaattctacgaattgaccaccatccaaatgaagatgattttgaacaaatttaccgttgagttgatccaagttatgttgctacctgtgaacaaattgccgacttggcatataaagcaaaatggaaaatttcccggaaaagtgctacattcatttaccttggaatttatactgattcaggtcgttttctttataaaaatacatcagctagaacacattttttgacaggaatattatttagaacaggatttaattttgcattaatccacgaaaaactaaatcaaaaaaaattatctgatattgattttgatagttatattttttctgtgaaaaaaatatataaaaatgtaattttttacacattgagtatggaagagcagaaaaaattaaataaaaatccctcaaattcagtgcgcccaaatttactagcgaatattgaaaacttcagaatttggttgtgtcttgttcaagaaaaagaaaattcctggcgggtagagtttcgttcatccggcccaaatgttcaaaaagttgctcaaaattgaggaggtgggggtcatcttaatgcttcgggcgcgattattgaaagtcttgataaattagatttattaattaaagactgccaagctgaatatgaaagttgattttctcagttaaaataaataataaaaaaggaaaagtaggcgaaaattactaattttttccttttttttaataaaaggctaaaaaaaattaatattggtggatgttgaaaggagaaactgatggaaggaatcaatataactaattttttaaaatatctatttgcatattattatattgatacaggtgaaagggaggtttatcgaacatgagtgcaaaaaatactttgatttacacattgaaaattttatagaatgtatcaaataccgtttttttcagagaattttcaatcttataaatatgggccaatttcctgaactgtattgcagacgcaattttttggtatcgaatccttcaaaaattcacaatacaatattgacgaaatattggattttcaccaaaataatcttgttgacgagtttaaaaatcgactaaaagaagactttttaaacgactttaacgaagattttggcgaaacatttgatgaaaatcaaataaaaggcgatttagatctaagatgatcttgttttgtttttgtttttgaaaaattaaaaaaatttcgcccaaaggatttaataaatttatctcacagccaaaaatcatttaaaatagcggctaaaaatccccactcaaaggttatttttaatgaaacaattcttgatgatgaggaaatttctatattagaatcatagaattttaaaattatttattaagaactgaacggaaaaaagtaattttaatttataatttaataaaattataaaaattataggaattaaaaatgtctttttttcgaaaaattagagaaaaaatttttggtacaaaacaagaaaaaccggcaaatttggataaatatgttgccggtttaacaaaatcaagactttcttttttcaaacaaatagttcagcttcaaaaaaaacatattaaaattgatgaaaatttcttcgaagaattagaagaaattttaataatgtctgatatttctccaaattttgtcagaacaataatagactcgttaaaagctgaagttcgccatcacaatctcaataatcccgatctaattcccgaaataattatggataaaatgtatacaatttattcaaatcgttcagttgtcaacacaaatttgaacataaaagacgggagaatcaatgtttttttaatctcaggggttaatggttctggaaaaactacttcaattgccaaagtcgcgcgaaaattcattatagaaggaaaaaaagttcttataatcgctgctgatacttttcgggcagccgcagttgagcaacttgaaatttgagctaaccgcgtaggggctttaattttaaaacccgaagctaatgaaaaagatcctggatctgtagttttccgcggtttggattttgctattaaagaaaaaaccgatttggttttaatcgacacagccggacgtttgcaaaacaatgtgaatttaatgcaggaattaaaaaaaataaataaaataatttcccaaaaggttcctaatgcccctcatgaatcacttttggtaatcgatgcaacaactggtcaaaatggggtttcgcaggcagcaaattttgcaaaaataactcccgtttctggtataattttaacaaaaatggatggtacaagcaaaggagggatcattttttcgattaaagatcaacttgatatcagtgttaaattagttggacttggcgaagcgatggatgatttacaacctttcgatcttgatttgtttatttttgcaatcacaaaagaagttaaaaatcaatatcaggtttaaatttttacttattttttacctaatttttaacaaataagtaaaaatttaagtattttttctaattttttcaataaaataaaaaaaattagaaaaaaaataaatttggttaaataaattttccatttttgtaaaatttatttaacaaaaatggaaaattaaaggaaattaatggctaaaatcagtttttttgcacttggtgggcaagacgaaaatgggaaaaattgttatattttagagattgacgataatattttcataattaattcaggggcaaaaataccactggatagttcagttggtgtcgatacaattattgcagattttacctatcttgaggaaaatcaacataaaatcaggggtgttttcatcactgatgctaaaaatgaatcattttctgccttgccgtggttgataatgaaattgaaaaaaatcaagatttatagctcttttttcacaaaagcactaattattgaacgaatccataaatacagactgtctgaatctgcttttgaagtaattcctataacttctgagctaaaaatcaatgaaaagatatcagtttctccttttccagttgcgggttctatgcccggaacaattggtttttgctttcacacagaggatggcggaatcgtttttatggctaattatgtcgttgggaatttaggtgtttatggggagacaaattttgaattgatcaaaaaaattagtcaaaatccaaaaggcattttgatgtttatttctgattcaggtaagtcaaacttacctggaaaagcaataaataaactttttgcaaaaaattttttagaaaattttttcttaaaagccgataaaaactcgcgaattgtggtctcagcttacgatgaagaaatggtttcaatacaagaaattattgatctttcgataaaatttaaccgccaaattaccgcttatggtaaaaaatatgataaattatacgatatgatctacaagttagataagctaacaactaataaattaaagaaattaccgacattttttgactataaatatgcaaataaacagaaaaattcggtgattttgattacttcaagtcccgaaagaatttgttatcgctttaatagaattcttgaaaacgatgatgtttattttaaattaaaaaaatctgattatgtgataatgttgacccctccaatcaacggaatggagcaactttatgcaaaagttttagaccagattgccaaatcaacaacaagtattgttgatatttcagaatcagattttggacttgctcgcccttataaagaagacatttctgagatgattcagcttctaaaaccaaaatattttcttccaattcaaggtttatatcgctacttaattgtggcctcaaatatcgcggttgcaaataaagtcaaacgacaaaacattatcgttttgcaaaataaaaggtctgctaatttcattgatggtagtttattttcaagaaaaaaaatttcaaaaggtgaggaagaaatttatgtttctggttttgggattggtgatgtttgctttagagtactaaaagaaagagatgctctgtcacgcaatggtttgattattgtttcttttttattcgatccaatcgaaaaaaaaattttttcaactccagagattacgacatatggaattttaagtagggaaaatcgggaagcttactatgatattattagaaaaattatttttaataatttttctaatataaaaaaaataaatgataaaatactaaaggaattgcaacaaaaaagtcaaaaaaatataaagcgaaaacttttaagaatttttgacaaggaaccaagcgtttcagttctaattcataatatttatccagaggtaaaaaaaatgaaaaaaatgctatgaaaacaagccgaaaacgaattaaaaacaggcgtagtttaccttgaatttgcagcggattggtgtaatgactgtaaaatgcaagagcctgtaaatgaagaattaagcaaatattttaaagaccgaagtgatgtaaaattaattaaagttgatgcggaagaatccaaacttttccgtcaaaaagggacaaaatatgaagtactttttgtcccaactcattttatttttaaagatggacaaattctttttaagcagtttaattatgttccagccgaagttttaattgaaaagattgaaaaagcacttaattcatagtaaaaattttttaaaaaaataaagcaaattactagataacaaattttgctaatttgctttgttttttgttataatttaccaaagatgccaaaattagactcaaaaaaagaaaaatatcttaaacaaatagtcgaaaatttcataaaaaccggtgaatctatcggttctcttaacttaaaacaaagttatggtatcaaaaaatcaccttcatatcttcgggcaattatgaatcaacttgaaaaggaaggattcttagaaaaatctcatagttcaagtggcagaatcccgactttacaaggttttcaatattatgcggaatttttatcttttgacgaaaatgaaaatttagcaaacaaattaaaagatttattcgcccgtcgtcgcataaatattgaaaacacaatttctgaagccgttaaattaatttctgaatcggttggtactaccctaattgcaacaacaaataacgaaaatgaacgattaatgtcaataaatttaacgcaaatttcccaaaatgaaggaattattgttgttgttagttccagtggtaatgtggaaaataaaaaaataactttttctgaacagattccaagacaagatgttaaaattgctattagacttttccaggaaagattaataaatacacctttgcttgaaatttcttcaaaattagctattttaaaacaggaattagagaaacaaattaaacacagcgatgaacttttgcatcattttatggaaaaaatttttaattttcaagtccaaaataagtctaatatctacaataaaaattcgctgattttggacaaggagatttcgcgggccaaacttgttgatttactttatataattgaaaaaaaatcaatttgagaaatgcttgaagatcgaacaacaaaagacgatgataccctaaaaatcagtataaagtccccagaagtttcatttatttcgaaaaaatttgaaaaatttttaccaattaaggaaatcagtatggttggagcagctaaaaaaattaattattcggccgctcgaacaggtataaaacttttggaagattttttatcaaacaaaagcaagattagaaagggataaaaatggtatttggtgataaaaaattacaagaatttgaaaataatttgcaaaatttgtcttctgataatgatttagaagacaaaaaagttataaatcctgatgaaaaacaagggctcgaaatagataaagaagtagaaaaaactgagaaaactgagaaaaaaactcgtagatttttgaaaaaagaagcaaaattaaaagaccttgaaaatcaaattcaaaatttaaccactagaaatataactctcgaaatcgaagcaattaagttaaaagataagatcaaaaagttagaggaagattttaaatctcaggttaaaacttttgaagaaaaagcaacacaaaaagtcaaagaattaaaacttgatttacaaaaaaagctcgaaaatgagcaggatttacttaaaaaatacagtttacaaccattttttgaggattttagctcgccttttttaaacctaaaaaaagctatttcttatggtttaatctctcaaaatcccgaaatttccgcgtatgtaaaaggttttgaaatgcttgtaaatcaaattgaaaatgtaatggaaaatttcggtttagtcaaaatatatcctaaaataggtgatttttttgactcatcagtccacgaaatttatgaaataaaaacaggggaaaatgataaaatcattgaagttgtttcagaaggttataaattacacgaccgaattgtgaaaacagcgcttgttgtagttggaaaacctaatgaagaaaaaaattagccaggcaataattaaattttttaaaaatgaaaatttaattattgatgaaagtaaactaattattgaaaagtcaaaaaattttggtgattatagctctaatgttgcgctaatttttgctaaacagaacaaaattgactccctaaaattagcacaaacgattaaaaatcaactactttcagaaaatttaaatttagaaaaaatagaaatcgctccccccggctttattaatttttttatttccaaaaatgaatatgcaaatatagtttcagaaattattcaaaaaggtgaaaattttggccgttattccttacaaaaaaaaataaaccttgaatttgtttcggcaaacccgacaggttttttacatcttggtcatcttcgaggcgcagttattggtgatattttagcgaatatccttgaatttagcggaaattttgtttttcgagagtattatattaatgactttggtagtcaaattgatcgcttggtgggctcagttttttcccgatatcaacagatttttaaaaaattcgctcttcctgaagaagcttatcttggcgaggatataatttggtgcgcgcagaaattttttcaaatttatgcaaataaatttgaaaattcatcacttgacgatttagaaacttataaaattttccgtgaaaaatctattgagatttttcttgacgaaattaaagctgatttggcaaatttatctataaaattcgatgtttttagctcagaaagcgaactttttaggactgagaaagttcaaaaaaatttagcaaatttaccttttgtttataaaaaagaagaggcaatttggcttaaaacttccaaatttggtgatcaaaaagaccgtgttttagttaaaaaaaacggagaatttacttatttttcaagtgatattgcataccattttgaaaaaattaatagtaattttaagccggattttttgataaatatttggggggcagaccacattggttatgttgatagaatgaaagcggccctaaaaactgttaatttaaatcaaaaattagatattttactatatcaattagtaaaattattcaaaaatggccaagaatttaagatgtccaaacgaatggggaaaacttttacgattaaggatttacttgaacttgttgatcaagatgcaatccgttattttattagtgaaagaagttataactcacttgtcgaatttgatatcggtctagcggctaaaataagcctgcaaaatccgttgtttttaattcaatatgcccatgcaagggcctcgaaattgttggcaaattcgacaatagttccagaaaaaatattaaaatttgaagctgaaaacgagactattttgatttcaaaattaaaacaatttgaagaaattgttttaaaaattacaaaaaattataaaattaacctcttaaacaaatatttgcttgaattagctaatctttttaactcattttattctaattcaaaaataattggtaatcaaaatcaaaatagtctcttatccctgacaaaagcagttcaaatagtactaaaaaatggactaaaattacttgggattaaagccaaagaaaggatataaaaacgtgaaaacaatcatttcgattgcaattgattttctaaaaaatcgtgaatccgctcattttagcgacatttttttagaagttcaaacttctttgatgtcaaaatgagaaaatcaactacctaatttatcaacagataaaattttaacactaaaacggggcgaattatacaaattactatcaattgatggtaattttgtcccactcggcgataattattgaacacttagatcagatcttaacgcttagtttttttttttttttttttaaaaggtttcgactgcaaaaaaaaaaaaaaaaaaaaagtatcgaaagggaaaaatgcaactagtaaatactaaagaaatgttggaaaaagcactgaaaaataactacgcaattccacatattaacattaacaatctcgaatgaacaaaagcggcacttttagcggcccaagcaaaaaaatcacctttaattattggcacttccgagagagtactgacatatatgggcggactcaaaactatttataatttagtaacaaatttaattgactattttaaaataacagtcccagtcgctctccatttggatcatggaacttatctcacctgcaaagaagcactaaaaaacggctatacctcagtgatgtatgatggttctaaagaaaaatttgaactaaatttggaaaggacagaggaaattgttaggctagcaaacaaagtaaatgcaaccgttgaagctgaagttggccaaattgggggtgaggaagatggtgtaattggtaatggagaaattgctgatccggaaaatgcaaaaaaaataacagaaactggaattacatgtctggcagctggcattggtaatattcacggtatttatcccccagattgaaagtccctgaattttgagattttagaaaaaatctcaaaagtaacaaagattccgctggttttacacggagggagcggaataccaaaagaccaaatccagaaggcaataaaacttgggattgcaaaaattaatgtaaatacggaattacaacaggcaaatgcggccgcaatttccgaatttgttctttcaggaaaagtaaaacaaggtaaaaattttgatcctcgaaaattattagcacccggaactgatgccattcagcttcttattgaagaaaaaatcacagaatttggttctgcaaatcaagcataagttttaatgattaagtttgtcgcaacaaaaaatcaaagcggccaaaaattaattcagttaattaagaaaatacttttgaagtcgaattataacgaaattcaaaagtattttcgtactaaaaaaataaaagttaataatactttccaggaaaagaattatatcataaaagaaaaggatataattttaattttttctcaagaaaaactaaaaactttttcaaaaaaagtgcctgaatttaagttaaatttgaaaattatttatcaagatgaaaatattttactagttgacaaacctcaaaacttacaagttcatggtggtagatttaacctggatttagcagtctgaaattatctaaaaattccagaaaatcaagtttttaaaccttctcatattggcagacttgataagaaaacttccgggattattttatacgggctgaactatcaaagtgtggtcgaacttaatcagaagcaaaaattttttgaaaaaatttatacttttaaatcagatataaatttaaaaaacactataaaaacagatgtttttattagaaaaaacaactttcaacaaaaaatggaagttactttaaaatcaccaaactcattttttgcatctacaactttttattctaaaaatcaaaaaaaatttgccattttacatactgggaaaaaacatcaaattcgagttagcttatcacatttaggatttccaatttttggtgatgaaaaatatggtgggactagggataaaatactttatttacatagtttttcactaaaattttctggattaggaggctttttatcatacttaaataacaggaaatttatttcaaaaccaagttgatggtaggggcaattttcaccattttattattcttattatctaaataaaggctaaaattaacactagcttatacaaggtgttaagtaaaaattcattatttttatttgaataaacgctaatttctttattgcctaattggttattaattttatattttagtgatattaatttgaaaaagttaataaatttgaaattcttattgatttcaactgtttcagtatttcaatttgtggaaatttttgaaataaatactatgttctgtttgttgatattcttaaaattttcgaaaaaataattgatatctgccaagtaaatttcattacttgatattattttttcgtttttatttaaggaatttattttttcaaaaaaaaaaaaaaaaaagtataaagaaataaacatagaaaaaggtaagcataaaaattttaattaattttttttgaaaaagtattttatatataaccttattttttattaaggaaccaaaaacttaaatttccaatatgtttgaatttaagttttttacaagtcactagtaaacctatataaaatattattagggctaaaattggaatatagttgatcaaataattgaaaaactagtgtgattttctatgtgtatgttaattttgcagaatcctgatgtgaaaaccttttgtaaatttcaggaaaataattggaactataaaaatgaaatctgaatttcccgaaaaagcctgtaaaatagcgattttttgcttctaaccgccagatagatctttgacttgttgatttagtttttcaccttgagtattaagaaaatttgctcttttttcaagcaaattctgattaaattctttttgaattaagctatttccaattaaaatattatttttaacagaaagattttcaattaggttaaaatcttgaaagactgcattaattaaagggtttttctcttcattcgcttttatatttcgttgcaaaaacaacaatcaaattaattaaaactgatttttaccaaccaacttttcaactagaaatgtcatcttatttgaaataatttctaggttaattttcttaagaataattttataactgtttttttggttaaattattaatttatattttagatatttttatagtccttattttagaagttgaaccaccggtttgctgtaaaaaaatcatgaaattaacaaataaataaaagaaagaataaaaaacaatataattcaaactaataaaaaataaagacaaacttgctcatatgaaggaaatctgtagttattgtttgatatcgctgaataaatttcaggagtaattgggactattaaaattagcccaaaaacaaaaattaaaaaggctataaaaattaacgtcattcaatggtatccgaaaatccgggctgtttttgctcccaaagctttcaaaaccccaatcattttccgcttagaatctgttaaattttttgcataaaaaattgttaaaaccacaaggctaagtgaaaaaataatcaaaactgtaaaaattattacttgagtgagggtttgtaggtcgaaaaataaattgttgataatagaacttttttcaataggttcaaattctgggaaggttgatttaaatttttcaatattttcacttaaatttttatgctcaaaaaatacttttaaaagtaaaggactcaaattttttgattctggaataatagaatgatgaaaaataacttcatttttaatcgttgtttttagatctgttttagctttgatattttgtttttcttggtcattttggtcgaaaattccgactattttgaaattaaatatctgtccattatttttacttaaagaagaaattttactatcaattaaagattttttttcattaaaacttatgtagtcatttaaattctttgaaattgcaatttcattagaattttttgggaaatttccttctaaaagtttaaattttttaatttcaggctgattttcatagtaatttttggtaatttctaccctttttaaatcgtctgattctacaaaagagaaaatttgatcatttttatcaacattttttgtattttcaaaaagcgttgattttggcaaattaaagtgaacaaaagataaattaagattatcattgttaaaagaattatttactccaacaattaaaagctcctttttgtttttattatttaaaaaatcgataaatttaattttttttccaattggatctttaatttctaattcactagcaagagctgccgaaattataatttcattctcatttttaataaatcggccttgtaaatcgtttgttccgattttgaatcttttgctaaaaaattcggattcatcaacaaaatcaacaggagaattttttggctggttattattatatgaaaaaagcatagttggggcgctatacaacggtagaatttttactattttattgctacttttttcaattttatttatttcatcgttttcaaatttatcataattactgttttttctgattaaaactgaatctaaatgttcttgaaaaattttctcagtattgataccctgaacatttgagttgagcacaccgaataaaacaattccaaaaattgtggctaaaaatgaaaaaattaataaaattgttgttattatttttgatttaaaatcaacaattgacaacaaaagcccagttttgaatttgcctcaaaaattaatatgtttttccttatttttttggtgaaaactagaatttttattattattttcctgattttgtccatttttttcaaaaatttcaacatcaatagtatcttttttgatatggataatttgatctgcatataatcttgccatctctaaattatgacttacaaccaaaattgtcttgttgctagataatttttttaaactttcaaagactgctattccgttttctctgtctaaattcccggttggttcatcaagtaaaataaagtctgaatttcgcgaaaaagcacgtaaaatagcgactctttgcttctcgccgcctgataaatcattagttttttgttttaattttgaactttgaatattaagaaaactcgcacttttttcaagtaaatttaagttagtttctttttgaattaagctattgccaattaaaatgttatttttaactgaaagctgttcgattaagttaaaatcctgaaaaactacatcaattaaaggatttttttcttcttttccatctttaaaaaatagaatttcaccctcatcttttttagtaaaaccggcaattaaattaattaaagtagtttttccaatcccagattttccaattacaaatgttattttatttgatggaatttctagattaattttgtttaatattaaacggtccgcaatttttttacttaagtttttaatttctatcattttaaaaaattatttttaatacaattattcgaaattttaattagttgttttaatttttttaatagtaatttaaataattttaattaaattatcccataaattttatatttttttggttttttgtgtttttgggtcccttttcaaaaaaaaccttaacgttttgtatatatttcattccaaaattatctaaaaattatgcgattgatcttttgtaattagtccttaatgttagtaaagaaaaaattgaaaaaataagaaatcctgctaatcaaacaacaaaaacataaaaactgattatcgaatatgagggtagcacaacattttgccctgaaatccagtgataaatttcaggaattaaaggcatcaatacaacaaatccaaaaacaaaagctaaaacagagataaaaacacacgtcattcaatgataaagaaaaatttgtcattgtttggcttttaaattttttaaaagcctaattatttttctttttgaagatgctaaatttattgaataaaaaatcattgcaatcaaagaaatgattgataaaaacacagaaatcgcaataaaaaatcagcttaaaacctttattggtccttcaaaattgtctcttactgtcttaactggttcgagtttcttatattccggaaaagaatttcagaaatttttgatattttcatttaaatttttatagttaaaaaagatctttaaaaatataggtttaaaagtttttgatttctcaatgatagtgtggtgaaaaattacttcagttttaggaatagaatttttttcaattttatcgttaagttcgccattttgattttttgagtcgtaaaccccaacaattttaaagtcaaaattttgccctgtatttccacttcatgaatacacaatgttgttgattatggaatttttattagaatttataaaattttgtaagttacttgaaattacaatttcatcagaattttttgggaaatttccttctaaaagtttaaattttttaatttcaggctgactttcatagtaaattttgctaatttgcgccttttttgaattccctgactctaaaaatgagaaaatttggtcattttctttattcaagtttttttgcttatttttaataaaagtcgatttaggaagattaaagtgaacaaaactcaactgttgatttcattgattagaagcattatttattccaacaatcaaaagttcttgatccatcctaccatttatatcatcaataaatttaattttttttccaatggggttttcaatttttaactcttttattagtttagatgaaataataatttcattctcatttctaataaatctaccctgaaaatcttttgtgccaggcttgaatcttttactaaaaaattcggattcatcaacaaaatcaacatacccgtgactactttgttgaccattataactaaaactcatatatgtaacataaaatggtaaaattttagcaatatttccacctttttcttcaatttttttaatttcttcaacctcaaattgatttccaggaccttttcatattgaaattgaatctaattggtgttgaaaaatttttgacttgctaacagcctcaacctttgaagttaaggaaaaatagctaactattccaaaaatagccataaaaaaagcaaaaataagtaagattgtagaaaccatttttaatctaaaatcagcaaaaacaagcaaaagaccagttttgaattttgttgaaaaactaactggtttttgttcaatttttgtttcaaaatcaaaaatttcacttttgatttcctcgtttttttcacaaatttcaatttcaactgaattattttttaagtgaattatttgatctgcatatttttttgcaagatctaaattacggctagcaaccaaaattgtcttgtttttagataatttttttaaactttcaaagacagcaatttcattttcctcatcaagatttccggttggttcatcgagtaaaataaaatctgaatttcgcgaaaaagcacgtaaaataccgactctttgtttctcgccacccgataaatctttgacttgttgatttagtttttcattttcaatattaagaaaatttgctcttttttcaagcaaattttgatcaaattctttttgaattaagctatttccaattaaaatattatttttaacagaaagattttcaattaggttaaaatcctgaaaaactacatcaattaaaggatttttttcttcttttccatctttaaaaaagataatttcaccttcatcttttttagtaaaaccagcaattaaattaattaaagttgattttccaattccggccgcacccacaataaaaacaagtttgtttgcaggaattacaagattaatttttttaaaaattcatttattagcatcttttttatttagatttataatttttatcatttttaattaaattattcatattttttacttttagtaattcataatcatattttttaataaaattttgaaatttttaattttttaaaagttgtacaactggttttctataagttcatagcgaagttattatataaattaaagttaaaattgtaaacattatggctcaaataattgaaaaaacaaatataacctgagtatatgagggttgggcaaaatcctgatgagagattcctttataaatttcaggaataattggaactataaaaataaagcctaaaaataaaactgcaaaggataaaatcaacaaatcgagccaatgataaaatagaatttttttggtttgggcacctaaagcctttaaaattcccactgtttttcgttttgatcaacataaatttcttgcaaaaaatccaataaatatagagaaggtgatagaaaaaattattaaaaccccgaaaagaatcaattgcagaattattttagcattaattaataatccaagggttctttctgcaccaccatttattaaaaaatagggatgatttttttcaaaatttttaatattccggtataaatcatcgtttgaaaagtataacctaagtgtgtttggtcttaaggttttttgcattttttgaatttgatgattgagaacaacagttccaaatctaccatcaactgcaccatttagttgtttttcaggttcaaaaaccccaacaattttaagaaccacattttggttggctaaatttgtgttggtctctaaaaaatcaccaattaaatttaacgaatccttcccgataaaactataatttgaactaatagcgatttcatcataattttttggaaaattgccttttagtaattttagtttactaatttctggttggttatcgtaataaaatttcgaaacttctttttcttcaccgtctcgaatttcgtgaacttggtctacccgagccgttttataatttttaccaattcaagaaatcgactcaaaaggttctaatgtttgatttttcaaatattccttttcaaaaatcgatttaattaaattatgatgtaaataagaataagcaaaattttcaactagtttattatttactccaactatagttgcttcaatatgcctgaattgattaagatctaattctttgttttttttatcaatttttgctaaattatagtaaacaacattaattttctgcccaattgggtttttaatttttaatactctaacaacatctgttgatattatgatttcattttcatttttgataaaattaccatcaacctcttttgtataaagtcgttttttaaaaaaatttgactgatcaattggcataattagattgtcaattgcaagttttttagaataaaaaaaaccaatatttctcattaagttttggtaatccggtattaatttttcgatttttgaattattttttacaatctcttgctgatcttcctcggaaaaaggaattcctataaatggtctatttataattactgagtccatactatattcctggaccttagacaaattgagattttttgcagaaatctgtagtgaagtgaacaatgtgcccccacttataaaaacaaaaaaaacaataattaataaaataaaagttgttatttttgttttaaaatcggcaaaagctagcaaaaaaccagttttatatttcgttaaaaaattaaaaactggtttttgttcaatttttgaaacaaaagcagaattttcactctcattttcttgtgtttttttctttttgtcaaaagtttcaacatcaatagtatcttttttgatatggataatttgatctgcatatttttttgctagttctaaattgtgactaacaaccaaaatagttttgttttttgataatttttttaaattttcaaaaacagcaactgcattttcctcatcaagatttccggttggttcatcgagtaaaataaaatctgaatttcgcgaaaaagcacgtaaaataccgactctttgtttctcgccacccgataaatctttgacttgttgatttagtttttcattttcaatattaagaaaatttgctcttttttcaagcaaattttgatcaaattctttttgaattaagctatttccaattaaaatattatttttaacagaaagattttcaattaggttaaaatcctgaaaaactacatcaattaaaggatttttttcttcttttccatctttaaaaaagataatttcaccttcatcttttttagtaaaaccggcaattaaattaattaaggttgattttcccatcccagattcgccaactacaaaagttagtttgtttgtgggaatttctaaattaattttttcaaaaatcgatttagtttcaaactttttacttaagttattaattattatcatcttcttcaggtaaatgcccgtatttttcttcgatataacgacctaaaatatcaggaaatgatgttttaggttttctttttcgtcgtgttgtaatcattgaattttcagtattaaacattaaaaattcatcttcagtttctattgctcctactccatattgcccatatgaagttactttgtatctccaacccgtacccgcataagttattttagcttgtggtaggttttgaacacttttagtaataaataattctctagttccataatctattccaatttttatacctaaattagatctgaaattaccattatattttatttccccgcctacctcaaaggaagggctacctaagcccgaggttcaagtttttaaggttgcttcaatatattttggcttacttgttatataatatggacttacttttttttgatgttttactgttaaattacttgctcatgcaactttatcttcccaaaataatccaccaaaataaactatggattttgctccgagaagcgagatttcccctgcgtaattatcttgttcaatttttaaatatttatcatctacatatttttgggctagcgcgaatgaacttaacgatttaaatgggtccagagcagaggaaaaaattgtagaagctattgaacttgcatttttaatattttctttgcccgaataaaacccgtttgcattttcatttctaatagaaattgttgttgtggttgttgtaagaattgtacataaagaaccaaaaattccgaaaaataaggatattttttttagattcttttttagattttgcattattactaattcctttcggttttataagttaggtttgttgggttttaacttaaattttactatgcaataattttaacaaaaaaaaaaaaaaaaaaagtaaaaataaggaaagaagaatatttataaaacattgaataatattgaattatttgcaaatatcagaataaaaggtcacttctttactaaatcaaattattttactatagaattttatattaattagtatgtttgcctcaaattcaacactttttattataaaatcaaaaattaaaattgtttttttatgataaaatatcaaagaaataaatttaataactatgttaaaatctaaaaacttaagtaacaaatttctaaaatttattaagaaaaatcgcttaattattggtgttatttttatttttacttgtgttttaatagtttctgcgctttttatctttgtctaccaattaataaatgtcgaaggaaactcaatgtttccaaccttaaaaaatggccaacaaatttttattaacaatgtcaaaaaacctcagcgaaatgatgtggtagttttcaaatataaagataaaattttaattaaaagattggctggaattcctggtgataaattagaagttactgaaaattctattttaataaatgatgaattagttgctaattttactgatttaggtttttggaaatttaacggagttattcccgaaggtaaattttttgcacttggtgataatataaattttagtaatgatagccgtacttttggcttttttgatttaaatgatattaaaggtgtttgggcctaaaagctgtttttgtggttaaaaatttgccaaaattttaaaaattttatatttatgttaattgttatactatattttttcagaaattaaccaacaaaaaaatttttagttggttaaaaatttaaattttttgatttttaagaaaattttagtgtataatctgttatttatataaaaaataataaagaattttttgggggagaagtggacaaggaaaaaatattaaaacttgcaaaatctctctattttgtcccaaatgagaaggtaatttatacaattttaactgaaaaagatcaaatgttagctcgaattaactatttgcaccagtttgatacaaaaaacattcaaccacttgaaaaaattaactcactgccaaaaggtatagaaattttatttgaggatattccagcttttaccagttttagagaacaactttttgacaattctattcatagcagtgaaaaccaaattataattaaaaaggtaattgatgactaaatttcagcttagttttcaaggagcacttgagaaattaaaaaatgataaaaataatacggttgcttacttttttcaagaaaaaaacaacaaaaaaggtgttttggcaaataaattttttagcatcaaatcgaattttgcaacaactgaaggtgtttctcatgcttcttcaatttcccttttaaattttaaaccctcttataatgcaactgtttttcaaaaattaattaatgccggagcacaaccacttgtaaaagttcataatgacgagttgggtttaggtggaaaaggtcttttttcagctttcggtaaaattgtaaatcctttagacaaaacaaaattaattggcggatcttcatctggaagtgccgcaacaattaattttgttcacttcgcaattggctcagacaccggcgattcgattagaaggccggctagttttatcgggaaagttggatttaaaccttcatatggtgctgtatcccgttatggattgtttccttatgccacttcgttggatacagtagcgtggttaactcataatgttctggattctattttagtatcacaggtagtttttggttctgatgaaaacgacttaacatctgttgaaatcgatgttaaaaatgttgaaaaaacaaaaccaaaaaaagttgcatttcttgatttggatgctgaaattgaagattatgtagtaaaaaaactctataaattacggaatattttaaaatctgaccaggtagaaatagagataattaaaccagatttaaacctattaaaaacaattctacctgtttatgaaataatttcttattcagaggcaacctcaaatttatctgcaattaatgggataacttttgggaatactgaaaaaaatttaaaatgagaagagatttttattagaacaagatcagatggttttggtttgatgctgcaaaaaagactaatttgaggctctttttttcttgaaaaagataatcaagagcatttttttattaaagccaaaaaaatgagaactttaattaagaattattatgaatctatactgaataaatttgatttagtagtttttcctgctttttatggcattgcccctgatattcaaggtgaaaacagtgaaaaaagtgataaaattactaattttattctagctatttcaaatttagttggcaatccatcaattagtttgccattaggtagttataaaaatttaccttttaatttagcggttgattcaaaaataaattctgatgcagaattgttaggattttccctttatcttgaagaaaaaataagcgaaattaataatgaataataaatatttagtcacaattgggattgaaattcatttggaattaaatacaaaagcaaaaatgttttcaaattcaccgaatttacgcggtgaagcaaatcaattttttaatctttttgatctagcttatctcggaactttaccaaaaattaataaagaagctgttaaaaaagcaataattttggcaaaagcactaaaaatgcgaatttcaccaattttagcttttgatcgaaaaaattatttctaccctgatttgccaaaaggttttcaaattagtcaacaattccatcccattggaaaaaatggaattttaaaagttggtgattttaatgttgaaattgaaagaattcatcttgaagaagatacggcaaaacaaattcataaagataatcaaacattttttgattataatagatgtggggttcccttgattgaaattgttacaagacctgtaataagttcatcaaaactagcagcaaaatatgtcgatgaaattaaaaaattaaccttatttttaggtatttctgatgcaaaattagaaaatggatcacttcgtgctgatataaatatttcagttcgccctgaaaatcaagtcgaatttaatccaaaagttgaaataaaaaatataaattcaatttctaatatccaaaaagccgccgaacttgaaattcaagaacaaatttatgcctatgaaaacggtataaaagtcaagcaagttacaaaaaaattcaatgatgttattgcaagaaatcaaattttaagacttaaaacagatgcaattgactataaatattttccagaacctaatttgccatatattgaactaaagccagattttgttgataaaattcaggttccacttaccccatcagaaatagaaaaaatgcttaaaaaagaaggagtttccaccttttatattaatcagatcttgaataattttaactactgaacctacctaaacaactccaatcctgataattgaagtttaagtgttaaattatttttttctgaaattgtaccaattattaataagctagggttcgaaaatttagcaatagaatttgatttttttgggaaaataatccaaaaacattttaacaaagaattgtcaaattccgaaattcgcaaaataattgaaataaaacaaacaaacaaacaatttaatttaaatgatattttatctaacataaaggagaaaaaactatctgaagcagcaataaaaaacttgttaaaagaagtagttagtgaagaatttgctcagattgaaaaaaatagacaggataagtctaaattatttaaatttttaataggaaaattaatgcaaaaaacaaaaggaaacgccgaaccaattaaagtcaatcaagttttaaaagaatggttagatagttttaactaaaaaataagtaagatattacagagacaaaattgttggttatttttctaggtaaaactcaggattttccaaaaaaattaatttatttttttgaaaaattaagtaaacctttttcattaaaattttagtgattcgtaaaaaccagttaaatattaaaattttaaatgttttttaattttagtagtcgacaaaatttttgatttttttaaaaaatcgcaaaaataaggtagaatttaaatatgtataaagctgagataaaaagattattaatttcacttaaaaatttaacaataactttaatatcaattcggggtgttaggtttgttatagaaattatttggggtattatggcattctgacttttaacaacctgactttttactgcctcttcagaagatataactgatcctaaaatttgacaagagaagcaagatgcagttaaaaaccaattatttaggttttcagggccacaatttattttgcttcttgttttaatcgggctaattatagcaaactgaattttttatataatgttttttataaagttaaataggcttcaaaaacttcacttttatattcaaaacccgataataattgctagattatccacaattaagtcatatactattattggtttttttgttgggtatgttgatttggtagcggctatttttgctttaaaattagttgtatcagattgaagaagactaacagaacctgaacaaaagaagttagaaatttaaaattatcctttaatttatgttattttttaaaaatttgtcgtatcttttgggaataattttcaaaaaataagttagaaaaaattcattatctaataaattaataaggactgagattattatttgtcagccttttcttttggttgttttttcattcttcttccatcaaaattctttaaaaaattaataagatgaactaaaacaataccaattggtccagaaaaaataaataaatcagcaaaattaaatgtaccacttgagggtaaatatggtaaaaaaagcaaatcttttacggtattattgtttaaaattcggtcaatttcgtttcctcagttacccgctaaaagtgttgccataaagatagtgagtgaaaattttctactaaaaggtattaaaattaaaagaatcgctgtcaaaaaaaaagcaaaaatatgaattcccacaaatccaatgattttgttaattttagaagttacaccttggtgcaaaagtggccgaaaaccaataaaacctcatgaaatattttttataaagccttttttggttgaaatttcgtattcatctcaagtaaaaattaaattttttgttaattggtcaaccaacaaaaaaactaaaataattgaaaaaccaatgataatatttaaaataaatcgtttttttccaacaagttggtattttgttttggtaaaattaactatttttttcaggtacaatttcacttaaaacctcaaaacaacgcgcacatactttgtttattttttcaaaatgattccaacatcttgggcatttttctcaatttagttgtaaaatttccgtttttccattagaaaattcaacttttgcaaccattaacaacttcttaaggtcgattgattttataaagtctgagtcagtttttagtaaaacacctacttcatttggtcgtttaatttcctttgacttaattttttgctcaattagttggtaaactgaatccttaatttggaaaaattcgtttcattttgcgtctaattcttcatcaaaatgtgactctttaaagaattcttccatatgaactgaaatttgcttgttatttttttgtataaaactgtaaatttcttcggcagtcgttggcataattggtgcaattgcaatatttaaaacctgcaaaagttcatataaattatactgaacttgccgtctttttaaggactcttttttatctgcgtataaaatatccttgacaattgaaagataaaaattcgaaaattcaataataaaattattaataattttgacaactcgaacaaagcgattttgatcataattttgaataatttcgttttttaatttttgaattttattgaaaatatataaatccacttcagttaattcgtattttgttggcttaaaatcggctaaattggtgattaaaaaccttactgtgttgcgaattttgcgataaatttcaacattttgctcaaaaatcgcctcagaatacacaatatcattataatattcgctgtttgcaactcaaagacgaaaaatatcgcagccatatttgcttaaaattaagagtgggtcaactccatttcccctggattttgacattttattcccctttgcatcaacaacaaaaccgtgagaaagtaattttttataaggagaaaatccaaaataaattacagaatttatcaaagacgagttgaatcaaccgcgatattggtccgaaccttcaaaataaatatcaaaaggaggtttttcatcgctaatatttgcagcaaaaaaactaacaccggaatcaaatcagacatctagaatatcattttccttagttcaacctaaattttggtacttttctggtaaaagttcatcagtagttttttcataccaaattctagaaccaaatttttcaacaagtgaaattatataatcaaaaatttctggcttatcaaggacaggatctttattttgatcatagaaaataatcaacggaattccccaacttcgctgacgtgagatcagtcaatcttttcgttcgactaccatttttgtcagcctttttttgagtcaattttccgggaattcaatttcttctattgctttttcaagatcttttttaatcttttcaattgagacaaaccattgcggcgttccgcgataaattaccggttttaaagttcttcaatcatgtgggaatgagtgatctataaaacttaggtgcaaaatttttgactttttttctaaaaattctgttattaatttattggaatcagcataaaactgcccggaaaattgacctgcattttcattaaattttccatcatcatttacatgcattaccatttcaaggttgttttctcttccaattcagtagtcatcctcaccaaaaagtggcgccaaatgaacaagtccagatccaacatctaaacttacatggtttccagaaacaattggacaaattttttcaaaaattgggtgaagatatttgattcccaaaatcgcccttccaggaaaattatctataatttcatagtgttttcagtcaaaaataacagctaatttttctagtaaattagctgctagaacataaaaattctctccattttttatgcgaacataatcaaaattttctccaacagcgactccggaattggcaattaatgttcaaggtgtggtggttcaaattattaatttatcattttcagcgacaaaattattacctttttttatatcaaaactcgtaaataaagacggtgaacggtattcaagatactcaatttcggcttctgcaagcgcactttggctacttggcgatcaataaactggctttagtgcccgataaacaagtccgcgactgaccatttttttaaataattttagttgttttgcctcataattaggcgtgtttgtttggtaaatttgtttaaaatcagttaataaatttaactttttaaactgcttcatctgtgctaaaatttgtgaatttgcaaaatcatttgattttctacggatttctagtgtcgattttgagccaatttggttgataattttattctcaattggcagaccatgagtatctcaacctggaacaaaaggtgaataaaatcccgccatagttttataacgaacaataatatccttcaaaattttattaagcgcatggccaatgtgaatatcaccgtttgcatatggtggcccgtcgtgtaggatgaaccgcggatttccgcgtctttttcttaaaatttgctggtaaatctgatttttttctcaaaaatcagcataaaatttgtctttttctgacaaatttgctttcattgaaaaattagaattaaaaatatttaatgaatttttataaaaatttttatccattatttgtcatccttttctatttttttcagaattaaatcaatatcaatttcacttactttccgaagtttttcttctaaagttgagtcattttttgatatagaattttgatcattagaattgctttttagcaaaaagttgttgttttttatgtggttttttcccgattgaatatttggtaaaaagaatttataatcttttttttgattagtttttagctttctaaaatcatttaaactaaaaatttttaatccttctccaaattcaaaaatttgcaaattttcgttataaattattatgctttttgggctcagggaaaaatcaagctttgttttaaagttttttggagtaagaattttatttccaaaaaacaaattttcagtattaattttttcaaactgtgaattaaagtcaataactgcaagtgattctgagctttcaatagtttgactggcactgataaattcattttttcggtgtctgaaaatttttatacctgtggaatttctagtataaattggaatttctgatatactcatttttagagcgcggttttgtgtggtaattagaacaatattttttaatttttcttctaaaaaaacactaattagctcatcaccttccttgaatcgaaagatattttgtaattttttttgcttaattttcattaattggtccaaattcattcttttagcaaaactgaatttggaaataaaaattaaaaattgactactttcaaaactatcagcaaaaaaaacacttaaaatttgttgattatttgggattcctaaagttatttttaaattattaggtgagtttttcagatttaattcaggaatttgatgcacagctaaaattgctatttcccctttattagttagaaaaactgctttttgtttttggttaattataccttgaaaaatgaaaaaatctccatttggaagctgagttttttctatttcatcagggagagaattttttatatctaattttttataaagtcccgattttgttattcaaaaataaaaaaactcatcttttactaattcatctttgttaatttttatcttaatatcagagtcaattatcctagtttttcgcggttttccgtgatgttttttaaaatcagttaacatatttattaaatttttatcaaattcatctttattttcaataagttttttgaacttagtaatgtttttttctaaattttttgattcttcaaggtaaatttgctgctcaattttcgaaagacggtataaacgcattgatgcaattgcctctgcttgggtttggctaaagttaaaaaatttaattaaatcattaactaccccaacttttgaattatcagatgcgcgaataaccttaataacttcgtcagtaatatcggcaactttgagaaacccagtaataatttctaatctttttttatttttgtaaagttcaaaattaaattcggcaagcttaatttttcttaaatgctcaagatagtaaaaaatcatctccttgattgacaaaagttttggtgaattatcacaaattgcaacggaattataagaataatgtatttgtagatgagttttttgtagtagataattaataattaggtcaggatttccgtcctgttcgagttcgatcaaaatggaaactccattttgatcggattgatcaattacatttttaatcccataaatttttacatcaaaacgaatgtcatcaatttcttcgattaaacttgactttgaaattccaaaaggaatcgaggtaatttcaattacattttgcccatttttttcgaaaattttataatcagagcttatttttattttgccttttccagttttgaaagcatcaaaaatacctgattttccataaacaattccgcctgttggaaaatcaggacctaaaattatagtagaaatttcttcaattgtaattcctggatttttaatcatcaaaattgctgcatcgatcacttcgcctaaattatgcggggggatttcagttgcaaatccacttgcaattccaattgccccatttattaataaatttgggaaaattgcaggtaaaattgttggttctttttcactatcatcaaaattagggcaaaaacttacaacatttttcgaaattaattcaagtaaatgctcactaatttcagccaatctaacctctgtatatcgcatcgcggcaggtggatcgtcatcaattgaccctttatttccgtgcatttccacaagcggagaattcatttttcattcctgggcaagtctgacaagagcatcatagattgaagaatcaccatgaggatgatattttccgattacatcaccgacaactctagcagattttttgtaatttttactattttttagccccaactgtcacattgaataaagaattcgcctctgaaccggttttaggccgtctttgacatctggaattgcccgttgttgaattacatattttgaataacggataaatttttctgctaaaattttttctagctgggaattaattactgaatcaagacttttattcataaattgtttcctttaaattttcaataaatttgtcttcaagggaaaaattaacgtttttttcaattcagctctttcttagatcagctctttcccccattaaaatttgaaaatttttctctacttttggataattttcaattaaaactttttccaaagttcgcctctcggggtccattgtcgtttgccaaagctgatttgcattcatttccccaagtcctttatagcgctgaatttgcaaatttgtactgtttttgatgtatttttcgaacttttcctcatcccagatataaatatcttttctccccttttcactaattcgatataagggcggttgagcaatatagacaaaacctttttcgattaaaggccgcatatgcaaaaaaagaaaggttaaaattaaaatttggatgtgggctccgtcattgtcagcgtcagtcataatgataattttgccataatttaggttcttaaggttaaaattctggccaattccagttcctaatgcactaataattgcgataatttcctcattttttaatagatcaattaatcttgttttttgggcgtttacaattttaccttttaaaggtaaaattgcttgaaactcacggtttcttgcaagttttgcagaaccacctgccgattcaccttcaaccaaaaaaagctcgcgattcatagctttttttgaatttgctggggttaatttccctgataaaatccgcttttcttttgtaattgatttgcttgtttttgactcaattatgcttaattttgacttttgtctttgggtataagtttctagtataaaattgattattttacttgcaacttctttatttagtgcaaaaaaagtcattaaatttgtaaaaattacctcttctgtaactgtttttgctaaaatagttgataatttattttttgtttgcccaacaaattcaagaattgattcaggaattcgcagtgataaaacagctgaaagtccaacttttgcatcactaaattctaaaatttgcttagttttaagtaaattattttgttggccgtaagtattaattgcctttaaaaaaccggatttaaaaccattttcgtgacttccccctaaatttgtttttacattattgacaaaagagataatattttcttgctgtgaattaacatactgaaatccaaattccactatgatttcctgcattttttctttaaaagtaataactttatcatgaattttttcttgatcattgttcaaaaattcaataaaactttcgattcccctttcgcagagaaactttttttcaatattgttttttgtatcaaaaaaattgatttttagattgttaatcaaaaaacaagtttcgcgtaggcgcgaaattatcatttctgagtcaaattctgaatgtgaaaaaagggaaaaatcaggtcaaaatctgatttttgtcccagttgtagcgctttttcctataattttagttcgagtttcaatttttccaccgttaataaaactagtatagaacaattttttatcccgatttatatagacttctagtttttcagaaagagcattaacaactgaagagccaacaccatgaaggccaccagcggttttgtagatatcagtagaaaatttcgctcctgaatggagctcgctaaaaactaattcaacgccagtttttccggtttttttatgaatttctgtcgggattccgcgcccattatcactaatttcaatagaattatcactattaattattagtgaaatttcatttgcaaatccagcaattgcctcgtcaattgcattatcaaagatttcccaaattagctggtgtaatccgtttttatcagttgatccaatatacattcccgggcgtttgcggaccgcttcaagcccttttaaaagttttaatttttctactgagtaggtcatatagggtctaaatcctttctgaaaatgcgtaaaaatttttctaaattaaattttatacaaaaaggtaaataattttacaaaaattttaatgtaaaatttaaaaaaagtggtaaaattactaaaaataattaaattttgttaattttttgtttttttagtaccaaaactcaaaatagacaaaattaatataaaagaaatggagattcgcaatgaaaaaaatcgcaattaatggctttggacggattgggaggttggcacttcgtcgtctttttgaagttaatgatgaaaatttacaggttgttgcaattaacgacttaacagatgcatcagttttagctcatttatttaagtatgattccgcccatggaaagtttaacggtgaagttgaagttttaaaagataacggaaaaaattaccttaaaattaaaggtcaaaaaattcttgttttatctgaaagagacccaaagtccttgccttgaggtcagcttggaattgatttggttgttgaatgtacaggattttttgcttcaaaatcaggagctagtcaacatttagaggcgggagcaaaaaaagtaataatttctgctccggcaggaaatgatgttaaaaccattgtttataacgtaaattgtgatacaattactgaagatgatagaattttatcctcagcttcttgcactacaaacgcacttgccccacttgtaaatgcgcttgataaagaatttgggatagaccacggatttatgacaacaattcatgcttatactgcagaccaaagattacaggatgctccacatggggatttaagaagagctcgagcggctggagtaaatttagttccttcatcaacaggtgctgcaaaatctattggacttgtagttccttcccttacaggaaaattggatggaattgcaattagagtcccagtgattacaggatcttttgttgacttaagtgttgaacttaaatcaaatccgtccatagaagaaattaatcagaaaatgagagaatatgcaaacgaatcttttgcatattgcgatgagccaatcgtttccagcgacattattggtgacagacacggatcaatttttgatgcaacattaacaaaatatattgaagcaaatgggaaaagactctataaattatatacatgatatgataatgagtattcattcgtgtctcaatttgtaagggttattagagattttgtgcaaaaataacaaaaagtaagtaacaaattttgttaccaaaagtacttaaactaatataaaaatccttaataagagtttaagttccttatgaaagcaaaaataagggggtgattttggtaagatataaaagagaaaaaattaaaaaaatcctaaaaatacttagtattttcgggattttttctctttcttcttgtaattattatagttcagttcccttagttaataaaattaaaattcaaaattcaattccttacaatgataaaactgatttaagtcagactgtttcagaagataaagtacctgaaaaaaaagatttttttgttgaaccaaaagtaaaaacttcgaaattagatttaaatctcagtacaaaaaatcaagaaaactccaaaaaaatcgataaaaataatcagtatttttctacccaaaaagatcaaactacccaaaaagatcaaactacccaaaaagatcaaactacccaaaaagatcaaactacccaaaaagatcaaactacccaaaaagatcaaactacccaaaaagatcaaactacccaaaaagatcaaactacccaaaaagatcaaactacccaaaaaataaccttattaccgcaaaaaaagccaataaaaaaagttattgtaccccctgtttcacctgttgtacccgaagaacagcttaaaaaacaagtcgtacaaccttcaatttcacctgaaaatttaagaaaccaacctaaatcaatctcagataacgggaaaattagccctcctaacttagttagttctccaaagacaaaggatcagatttcgctaaaaccacaagatcctaaaaaaattgaaaaaaaggctataaataagttcgatatttctaaattatctaaatataacgataatgaaaaagtgcaaaatattgttttggggaataaaaccggaatatttaaaacatttaaggtgtccaccgataatgcaattttgcgtgaaaacggcgagtcattttcagggtcaaaaaacgaaggtttaaatatttatctactagataaattggataaaaataaaatagataagaataatccagttcttggattttttgttaattattttaataaaaattttcgcaaaaactactataaattaaatcattttggctttaaatcagttgattatgctgataaaagatacaatgaaatttatcagagaaacgtccgcttcagttcagggacatcaattttacttgatatgaatagtgaggaggcgctttttttaacaaataatcacgtattatttgacaaaaacaaccgtccaatgtgggctttttttggttacccatttatacttttttattttaataatcggattaattttattccttcccctgattattcctgggttttggacactctccaaattaaagaagaatatgagaaaaaaggtaataaatttcaaaaaaagtcgaattcaaaatctaaaccagaatttgttaaaaaaacttacgaaaaatactttcgacttgcccctgattttaacagaaaaaataaagatcttggacttttttactttaaatacaaagaatttatagctgatttttcaacggcggttaaattttttgaacaacatcaaaacgaaattaaaactacttttgactgagcaaaacggcaagatacacaaaaaaggttaaaagattttgaaagagctatccaagtttttagcaaatattttgagcaaatgtccaaattaggtcctgttaaattaagtgaaagggtctgaaaaaatggagatatcgactatgaaacaaaattaggcctattttggccgcgtcatatagctgccaaaaatatgttcaaaggggtttatatccgcgggcaagaggcaactttttttgctacaaatggccatggcgcatcgggaagtgggatttttaacacagatggttcgcttgcgtttgtaaattatataatagttaaagatacggcacaaaagtattattatagtgatcaaaataatttattcaattttcttacagccgcaattgctttaaagactccttatatcaatttagttgatgaaatttataaattttattataataaaaatgtaaggaatactttaaaataaagaattttttgcgagtatacttggcttatctaaattttttattttgcacaaaaatggaagattaataatttttttaaaaaaaaagtgataaaactgaattttaggctaaaatagcactaattttaccctctcaaacattaacactttcaattttaatatcaataaattcgcccaatttaaatcttcgtctgctattataaatgcaaaacccatcttctgtcaattggtatggatcattttcgttgtttgggagacttttattacttaacatcgcatcaaaaagtccgttaatttcaacaaaaaaaccagattttataattgaagttatttgggcattaaaagtttgaccgattaatttttttacatattcagttttttttatattgacaatttttctttctaaattaaaggctttttgctctagttccgtggtcaagtaggaatttttagttaaaatttcgttgaaaaaatcaaaatttttgtttttttcaaagataaaaaaacgaataattcgatgtaaaattagatccgggtagcggcgaattgggcttgtaaaatgggaataaaaattcgctgccaaaccaaaatgacctatgttttccgtgctataaattgctttttgcattgttcttaaaattgaatattttaaaaaattatcgttattttttgtttttatttcatcaatttttcttgcaaattcccttgaatttgagtttaattttaaagtattcttaactcctaacaccttcaaaatttgattgaaaatcataattttttcaggatcaggcttgttatgaaccctgtataaaattggaattttcctttttgttaagaattcagagacattttcattagctctaatcataaaattttcaattaattcttctgaggttcccctactttttaattttaaagattctgtaaaaccttgttcatccaaaataatttttatctcatctatggccaaatcgatataaccttgattttttttaaacagtgataaaatggtgtttaattcttgtgctgttttcaacattttttctaaattagtatcgttaaaactagattttccattaaaaaaattattgacatctttgtaagtcagtcgccattttgagttaattactgatggataaattttaattgataaattttcaccccttttattaattaaactttccattgttattgtaaatcggtcaacattcggctttaaagagcaaattccatttgataattcttcgggcaacattggaatgacggtgtgaggtagataaattgatgttcctcggcgttgggcttcaacatcaattggactatcctgcttgacataatgggcaacatcggcaatatggactttcaaaagaaaatttccttcatttgtttttttaacagaaattgcatcatcgaaatcttttgtatcttcgccatcgattgtaataactaattcatcgcgcaggtcggtcctgtttttttcaatattagtaatttccttttcaattttttcagcctcttcaagaacatcagcactaaatttattagaaacttcagattcaattattggaatttttacatacaaaaatggctcgcttttatgaccaattttctgaattatgcttatttttaaagtatttttttgatagtcaataatttttaccttataataattatcattaattaaatcatcagttgtgtttcaacggaacaaaaaatcacctttaaaatttacaggttcaaaatctcaatatttcccatttttaaaagcttttccgattaaaaacttgttatttctttgaataattttggttactataccaaatacctgatcacttttgaaacgatcagcataaatattaattttaacttcatcaccttcaagggcgctcgctgtaaaacgcccggggataaaaacgttatttttctggattggattttctttgtcttcaacaaaaccaaaagcagaattggttgctctgaaaattccagatgtggttttgagaaatttaggagcataatattttccttcaggggttttaaaaacaacaaaattttcaattagattactaatttgattagttagctggtgatttaaattgaaaggaatgttaaattttcgaacaatttcaataaaagttttttcttgacgcagaaaattttttaagcgctcttccgatataatttccataatatttataataacctaacaactaaagcgagcccgagaaagataaaacccacaacaaacattgctcattttgtgaattttttaaatccgcgttcttttgaaatctggaataaatctaggtcgctagaaccaataagcgctcccgaaaaagagtttgaatgtggcgacataagcagtgagattaaaataattaaaacaccaaaaatggcaataaacgtaacgatgattgttcttcacataattcaaaaacaccaataataatattaataattatactataaattagacagttttatataacagtttttaaaaaaaatataaaaaaacgaaggataaaaaaaacttttgataccttattaatttcaataataatattttgattttttagtacctgaatataatttaaaaagtcacctaaaatttttcctttaaaaaataaattagtttcatattgaaaaagaagcgatcgataatctaaattcgaggttcctatcattccatatttatcatcaatgattattgactttccatggaagaaaagttctttaaaatagtgtatttttgctccatatttcaataattttttagcaaaaaaatcattgaaagttttaataatttttgaatcatttctccccggtaagaaaaaattaacctcaattttagcaagcaaaatatcctttaaagcatcaataattttttgcgagggaacaagataaggggtaaaaatttttatatttttttttgctgaataaattttttttaaaataaaaccctcaattaatgagtgctcgaggttgggtccattttgaataactacaccaagattatcgtttttgtcttgctttagattagaattttcaatactgcaaaatccattgattttttcttttgatatcttttttttgcctcattttgttcaatggaacagaaaatttttacagtaagtttgaacaatttcaccttcaagtctaaggtttaaatccattcaatatccataatttttatcaaaacttgaatattcttcggatatattatttccgcctgtataagcaatttttccgtcaataatataaacttttcggtgatttcggtaaaaactttgtccggaaacaaatggaattttaaaggtgttaaagtgcaaaacctcaattttttgcttctttaattcgattcaatggcgcctttttataagataggtgccaaaagaatcgactaaaattttaattatcaccccgcatttccgcttatcaaccagtattttttttaatttttttcaaataaaatcattttttattatataaacatcaataaaaataaatttttttgcatttttaatgtcagcaaaaagtttttcaaaaaaactatgaccatcaactagcaaatttccattaaattctttaattggggatgaaaaatattcactagaaaaacttagtaaagtatctttagattcttgatttttccaggtttgaactttttcttttaggttagtaaaatttctgtattgtgcaaaatattttttaatattttgactttttaagtattttctgcctaaaaaaatatatgaaattgggcctattattggcaaaattgaacaagcaattaatcaagaaattttcgtttcataccttcttttttgtaataatataaataaattaaaaaaagaggtagaagcataaactataaaaatagtcaaaattgaaattcaattcatattctttgctaaaaaataatgaattaaataaattgtggcactaaaagcaactaaaaatattactaagaaacaatagtaaaaaaatcattttataaatttatgcattataataataattttactataatgtttgagattgttgttgattttcctttagtttttcaataatttgatcctttatttcattaaatagtttggtattattttcaagtagtaattttaaattcactttaccttgggcgatattctctcccttatatgcaaatcacgaaccttttcgtacaagaattccaagttcctcgcctaattgggcaatttctgctgattttgaaatacctttggcaaaaacaatttcaactaaagcagttttaaaaggaattgcaagcttattttttactactttgatttttacactatgcccggtgatgtcgtttccacttgttatttgttgaatttttctaacatctaacctgattgaagcataaaatttgagtcctcttccaccaggagtagtttcaggattaccaaaaattactccaactttttccctaatttggttaataaaaattacagttgtcccgtttttatttagagatgctgtgatttttcggagcgcttttgacatcagtcgagcttgtgctcctattacttgatctttcatttctccttgaagttcagccattggcactaatgcagcaacagagtcaactacaattagatcaattgcttttgtttttgttaatgtatcgacaatgtctaaagcttgttcgccagagtctggctgtgaaagtattaaattatcgatatcaattcctaaattttttgcatactgtggatcaattgaatgttctgcatcaataaaggcggcaattcctccctgtttttggacttcagcaatggcatggagactaattgtggttttccctgatgattcaggaccataaatctcaacaattcttcctttcggaaaaccaccaattccaagagccatatcgatagccatactcccagatgaaaaaacttctgtatcaattggcggcttttcacctaaaaccataattgattcgttaccaaatttctttttaatttctgcaagcgcttgttttaataatgatttttcgttaatttcagtcataattgtttcctttttttaatttttcggttttggtttgttgcttattctaatttaatattttttaaacattttaataaaaaaaggaaaaatttaggaaaaagtggccatttttcctttttttgaaaaaattttgtattttttcataaaatattatgctagggcggaaaataaaagtaaaaatttcagccctagtaataatttttattttaaaatttgaaaaatataataaaatttccagtatgaaaaaaattttgattggatttactaatgaatcattccgcgagggtaacaaatttatacaaaaaaaaatccataatggaatgaatcataaaatagattataatattttatcaaattttaattttgttccaaaattaattttaaattctaatgaaaaaattatttgggagtggattgatggcgaaaaagttgaaccaaaaattgaaacactagaaaaaattgcttctcaattaagagaaattcataattccaaccttgattttcctccctcaaatcattcctttcgggttgagcattatttgaaagttttatctgaaaaaggtataaataatacagttattgtaaaatattatgactttattaagaaaattcttcaaaaaatggataaatccaagccacttcataatgatttgtggttgatgaatatgattgaaaaagatcagaaaatctactttttagactgggagtatgcatcaaaaggtgatattcattttgatttggcttattttattgaatcagccaaactaaatagtgaaaaagaacgcatttttttaaatttttatggtataattaattatgaaaatcttctattacaaaaaattttagtattataccttataatattgtgagtgaatgcgcaagaaacaaaacattttgatgatacaccttatgcgaaaaaactagaagatttatatttggtttttgcatctcgaaaggaataaaatgcgatttgtcgactatgtttcaatcgaagtcgtggctggaaaaggtggcgatgggataatatcgtttcgccgggaagctcatgtcgacaaaggtggaccggacggtggcgatggtggatgaggtggttcaatttattttgttggtgattcaggtatgaatactttattacctttttatcaaaccaagaagattttcggttataatggcgaaaatggtaggccaaaaagacagactggcgctaatggaaaagatatttttataaaagttcctttaggtacacaagtttttctaaaaaagtctttaatttgtgatataattttagaaaaaaaatacttaatagccaaaggaggtcgaggaggtcttggaaattttcatttcagaaattcaaaaaataaggcacctcgaatttctgaaaatggggaattaggtcaaaatttttatcttgatttacaactaaaagttatggctgatatcggtttggtaggtaagcctaatgcaggtaaatcgacacttttatcactaatttctaactcaaaaccaaaaattgcaaattatgaatttacaactttagccccacaattaggtgttgtgaaaatttatgaaaattcatttgtaacagctgatcttcccggattaatccagggtgctagttcggggaagggaatgggaattatttttttaaagcacattgaaaggtgtcgagcaattgttcacgtaattgattttggttcagataacaaaaatccaattaaggattttatcgagataaaatcagaattagaaaaattcaataaaaagttattggatttaaaccaaatagttattgcaaataagtgtgatctacctaattttcagtttaatttagcaaattttaaaagaaaatttccaaaaatcaaaataattaaaagtagtttaatttctgcaaaacaaaacgaaattaatataattaaagagaaaatgtttggtttgttaggagaaaaacaaaaaaaattagaaattcaagagataaacacctcaaaaattgaatttaacttaaaagctccctttttaattaagagcagaaataacggtttttttgaaattacaggagaacttattcaaaaaattattcaaaaaatcccgctaaattctcaagagaacattttacgttttaatgcaaaagttaaaaaaattggactttgggatgaattgatcaaaaaaggaattaaaccaggggatttagttagaatctatgaatttgaatttcactggaattaaaattattttattagagcgaaaatcgctccaaatcaccaatattattcaaaaaaaatacaaaccatatgaaagtgaggaaacgcaatgagcgtagttgccaaaataaagaagttaattgcggaaaacccgaaagacaaagccgagtggtcttttgttgctaaaaaaacattagttgcattgttatttttatatcataaatcaactaaattaacttctcaaagagagaaagtttaccaaactttaggaatagttgaaaaaccaaaagaaaacaaagaagaggaagtttcagcgatagaacgtgcgctctcgctattggaacctaaatatacaaaacttttgatcaaagaatttattgacaacgattatagctgaataaaaaaatattgatcaaaatccacttattacaaaaatatgcacaatgcaattgaccaatttatcataattttaaacctttaatatatgaatttcgaattagctccttatgaaaatccggaaatccaaatagcaaggagttatgggcagatttcatttagttatgcatcaagttcttcaccaaacggaattagacagtttgtgaaaattgagcgtgatttatcttcggatcaatttagcgtgattgttactgttttttcaaaagtagccggaaaagttaatgtttatgttcaggttaataattctagtccaacagctccaaaattacttgaattattaccagaaaaattcaatcaagcagtttttacattcggagactttgggcaaacaaaagaaaaggccaatgagtctaaatttccgaaattagataatattttagtttacttaacaaaagaaaacgagcaaaaaatactattagataatgttttgaaggtgcgaaatttttcagatgtaaataaagaatattcgattaaaaaagcagggattggttttaagcttttaaaatcaattaaaatggcaaatttaggcgctgatgcctcaattgaattttcaaaaacttatgaaaaaattgatgaaaatacaatctatttttttcctgataaatttagtcaaaaaaaacacaatataaatatttttaaagttggtcttgatcctgaagtttttgaagctggcaatattgaaaaaaatattaatattagcaatctaaaactaacaaatctgccagttaaagcagtaaccggatcaaaaaatcaattggatttatcttttaaatttcgccaagatatttacgataaaaataagggaccggaaataattcaaggaaaatacattgttggtgatatttttataacatcaaatagttattatgatccaacagaaagagcagtttttttagggaattcgcaaatttctcagcaaggttttgtaattccctataatttttcagggacgctaaatcctaaagtagagatgagcatcaataatgactatcggaaaataaacgtcgctttttcacaagaaataccgaaaaaattaattgattatcaaaaaaagaatggaatttacaagctaaaaattacaaattaccctaccccttttattaaaacagatcgaattagaatctcaaatcaagattttaaatatgttgccactaattttttaacaattcaacaattaaaagatctttcttttactaactttaaagaagacgatgatgagaaagaattagaggaataaaattaagggcgcaattaaagtaggggcagctcttatctcggttgggataattgctggagctggttttggaggttggtatttatataatcacaagttgcaaaaatcaattccatctttaaaaaaacagcttgattttgatgtaaaatctgatactgattataaagatagtgatgtttttccaaatatttatgccaacgatttttatgatacaattaaggttaaaaacggggaagtttatattgatgagtgattagtggagaatgtaattaaggagattgtttcaaaaattaaagttgctttcggaacggtcaattttcgataccaaattgatgagaaaaaagaaacaatatatattgaaattttatgaaaatataaaaaacatatgttaaatcgtaactataaaattagtttatatcaggatatttaatattagttattttcgaaaaattaagtataattatttttgattttatgttaaaaataattgctcatattgatattgataacttttttgtttcatcagaactaaagttaaacccaaaattaaaaggacagccaattgtaatttcccgaagcgaggattttgcaatggctgtttctgtctctaaagaggttaagtcaaaaggtttcaaaatatcagataaaattaatgaaattaaaaaaaagatacctaatttattagtaattcatccaaatataaattattataaattcttatctgatcaattttttaattttataagtaaaaatttttcaaaaaaaattgaggtttattcaattgatgaatgttttattgatctaacagaatattcccgaaaatttaagtcaattacagatatgctctattttattaaaaataaactagtaaaaaattttagattaccaatctcaatcggactatcctataataaattattagcaaaaatggcaacaaatttagccaaaaattcagaagcaggcattatgcaggtttcaacaaaaaaagatgttaaagcttttatttatcctcaaaaaataggcaatctttttggaattggcattcaaaatactgaaaaattaaaaaaattcggaattatcactattcaagattttatccaaaaaggtgttaataatgagaaaataattgaaattttaggagttaatcgttattatttttttcatgcattaactaaaataggtgatgataatgtttgtgataaacttgaaaaattcaagagtgtttcgcattttcgcactttatcaggagatattttattaactaaaaagcaaattttagacggtgtttccgaatttttactagaattagtagaaaaactaaaaaaattcaacaaagcagcaaatcgtgttgaatttttttttaaattaaaaaataaagaaaaagatcattttttttctgatataagtttcccctcaaatgattatgattttctttatcagaatttgttagcacttgttgaaaaaattgaaaatttttctttaattcacggctttggtatcaccctatcaaaaatttcagattatgataaaagtatgttaaatactaatccaaaagtaaaaaatattgttgcaaaagttaataaaaaaatcgggctgaagaaattatttgtcctaaaataccttaaaaattaaaaaaatgaaaaaacttttatatttttatttaaaaatattttttctaatatcagtagttttagcttttgttgcagcttggaattacacattaatatttggatggcttttttctggcattagcgttttagcatcttttttttcaaaacacttttttttaaaaagaattgtaataaaaattaaaactgaaaaaactacgttttttaaaggattttttgcttatttgggattaattttatttcagggattaatattgatttccatttattttattaataaaaaattccaaaaaaccaatgctaatagcatttttggaattttttcttatcctgttaatattttttcttttatttttggctatacaattttcccggtttgtgctataataataaattctataaatataaaagttagtcaaaaacaaaaaaaggagaaataatggatttttttcgcgactgaaatcaaccgcaattatttaccctttttattctagtatttcttgtaataattttatcaattattattttttttcatataaaaaaagcaaaaattgatgaatccccatcagctgttgttttgtttgctgaatcttacctaatttttattgatgatttagttgaaactgctggagaaggttatattaacaaagtaaaaccatacattttttcactttttaccttttttttactaggaaatttattatcacttgttggcttagagccaatttcaacatcaatttcggttactttaagtttggcctttattagttggtttggaatttttgtagttggcgctatttattcaaggtgaaaatatttgtctgaatttgcaaaaaatcctttaaaaataatagggattccagcgccgttaatttcattatcgtttcgtatgtatggaaatttaatttctggatcagttttattattaataatttattcaggcgtccagtgaatttatcaaaaaataccattagggacttttggtaattttaatttgccgattgtcttgatttttccaccttttcttatttattttgacattgttggctcgttaattcaatcttttatttttgtaattttaacaacttcatattgaggtatggaggtaaatcaggatgaagcaagattaaaaattaataaaaaacaactaaatttacagaaaatttagacttaaataacttaaaaaaggaaaaaaatgaattctattgttaatttttcgcaacaacttattcaaaattttcaggaagtaagtcaaagaactgcggcagattcatcaaatttaaaagcatttgcatatttaggcgcaggactggcgatgattggagtaattggggttggtgctggccaaggatatgcggccgggaaagcctgtgatgcaattgcccgtaatcccgaagcacaaaaacaagtatttcgtgtgttggttatagggacagcgatttcagagacatcttcaatttatgcgcttcttgttgcactaattttaatttttgttggataattttaagcaaaaattaaaatttttattctttgataggtttaaaaaaagttaaaatggtaaatctgaatcaatcattgggtgacttatttaaagggattatccctaatgtttatgttttgggtgctacaatagttagttttttgattttgtttttatttattacttattttgtctatcgtccgttaaagaaatacataaaaaaacgtaaggattttttacaaaaccatatagatctaacaattaaatcaaatgtagaagctgaaaaacttgaaaaaaaaagtcaacaaaaactgctagaaactaaagagttttgcattgagcttaaagaaaaatcacaaattgaagctaatgaatttcttgaagatgccaagaaaactgcaatcgataatgcgcgtcaactaattaatgaaggccaaaaagttctacttgaatacgagaatgaaattaagtctaaatattatatgaatgttataaatgttgcagttgaaatctgtcaaaaataccttgaaaaacaagataaaaataataaaattctccagcaaagtctgattgctgacttggaaaaggagctaaaaaaacgcgaaaattcctccaaaaaaaaggataattttggtaaataatgtatttgtataaaaaaaattattatggttatgctgagagtcttttggatatttccatttctgaaaataatgttgaaaaatatataaatgattgtttttttattcttagtataattcagaataatcaggttttaatcttgttgtttaagtctcattttattggaaaacaggaaaaatttaacataatagataaaattttttcagcaaaaattgaaaaaattttagttaattttcttaaagttattgctaaaaataacctttttttatattataagcaaattttgctaaaatatattaagctggcaaattctcatttaagtcaaacttggggtgaaattgaaactgcatttccgatttcttcagtaatgacttcaagtttcgagtctattctttcaaaaaaactaggaaaaaaagttcatctaagacataaaattaattcaaaattaatttctgggattagaataattgttgataatcaaatttttgaaaattcacttttttccgaacttaaactgctaaaacaaaatctaaaaaaacacctaatcaccaaaaatgatctataaatttaaaggttttttattatgaataaagatataaatatagccgcaataatcaaaaatgaaatagaaaattttgaagggaaaattcaaaatcacgacattggaaaggtcattattgttggtgatggtgttgcgcttgtatcgggaattgaaaaagtaaaatttggtgaacttgttgaatttgaaaataatgttttaggaatcgcgctaaatttagaacaagatttaattggcgttgttattatggctagtgaaaattcagtttttcaagggtcgatagttagaagaacaaaatcggtaatttcaattacagttggtgatcaacttttaggacgagttgtaaatgctctaggaattccaattgatggaaaagcagaacttgataatagtctgaaaagtgcgatttttacaaatgcgccgtcaattatggacagaaaaagtgtggatcgcgggctaaaaacaggaattttagcaattgattcactagttccaatcggaaaaggtcagcgtgaattaataattggtgatcgccaaactggaaaaacaacaatcgcaattgatgcaattttaaaccaaaaaggaaaagatgtttattgtgtttatgtagcaattggacaaaaaaactcaagtgtcgcacaaattgtttcgcttttagaaaaaaaaggtgcccttgaatatacaacagtaattttggctggagcaagcgaactctcacctctccaataccttgcgccatattctggggcagcgatcgccgaatactgaatgaataagaaaaaagatgtgctaataatttatgatgatttatcaaagcatgcaattgcctatcgaactttgtcactacttttgagaaggccgcccggaagagaagcatttcctggggatattttttatcagcattcttacctccttgaaaggtctgcgcaactttctaatgacaaaggtggtggttcgattacagctttgcccataattgaaacccaggccggggatatttctgcatatatcccaacaaatgtaatttctattaccgatgggcaaatttttttacgagatagtttgtttaattctggccaaaaaccagcaattgatattggcctttcagtctcacgggttggttctgctgcccaaactaatttgatgaaatgagcatcttcatccctaaaattaaacttagcccagtataatgaacttaaagcttttgcccagtttggttctgatttagggcctagttcacagttaattttagatcgtgggaataaaatttatgaaattttaaaacaagaaaaccaatatccactaactgaaaggcagcaaattatgttgctaattttgattcgcgaaaatctaatcgatagtttagaacaaaaatcaataccattatttaagtcagcgtttttaaaatattgtgattctgagcccaaatttagagacaaaattgaaaaaatggattataatcgtgttctagaacccaataatcttgctggaattcttaaagatatcaccgattttattgaaaaattcaatttagggaatgtattttagttaatttttctgtaaaaatgagtaaaaaatgcccaaattaaaccgacttagagcccgatttgtccagattcaaaacattgaaaaaatgacaaatgtaatggaaatgattgcgaatgcaaaaattccaaaaataaaaaacaagtttaaaattgttcaagaatattttgaaaatttagattatatttttcaaaatattcttgcaaatttatctaagaaggttgaggaattaactaatgctgattccaaaaaaaatctttatattatttttggatcaaatttaggtttttgtggtgcccttaataatttaatcttaaaaaatgttgtcccacaacttcagaaaaatgatgaaattatcgtctttggtgaaaaaatttataattttttgtcaataaattactctaatttaattattaaattttttctaaatattgaagaaactaattttagtgaaccaattttagaaatctcaaactttgtaaatcaatcgatttttgagagaaaatataaaaaaatttttatttgttataacaaatttatcagtattatacattcaagcccagagatgcaaaatttatttgatttcaaaaaaaatactataaaatacggtggttacgggattgagtttgaaccaaatgctactgaggtttttaaaaaattaatgcccttttatataaaatccatccttgaaaaactttttatcgaatcaaaattagttgagacttcaactagacgaacatcaatggaaagtgcaactgaaaatgccagtgaaattttgcataagttagaaacagaaataaattcaagtcgtcaagcaatgattacacaagaaattattgagattattagtggtaaaatgtagaaaaagtaggtaaatttatggaaaaacaaaaaaatgttggtcatattgtacaaatttttggccctgtcattgatgttcagttcccaaacgaacatatgccggcgattctttcagctcttgaggttaaaattaacgatgagagtataatttttgaggtcgcacagcatttaggtgaaggaattgttagggcaatcgcaatgtcaatgacttataatttatcaaaaggacttgaggtttatgatactggttcacaaatttcagttcctgttggaaaacaagtactttctcgaatgtttaatgttttaggtcaaccaatcgatggcggaaaaccacttgattcatttataaaaaatcctattcatgcaaaagcgccgacatatttagagcaaaaagcaactagcgaaattttagttactggcataaaagtaattgatcttttaataccatttataaaaggcgggaaaatcggactttttggcggagcaggtgttggcaaaactgttttagttcaagaattaattaataatatcgcttcaaaacatggaggtctttcggtttttgctggagtcggcgaaagatcgcgcgaaggaaatgatctttattttgaaatgaaaaaggccggtgttctagataaaacggcgcttgtttttggacaaatgaatgaacctcctggagcaagaatgcgagttgcgctctcagcactaacgatggcagagtattttcgtgactatgaaaatcaggatgttctactttttattgataatatctttcggtttactcaagcaggctcagaagtttcaactttattaggaagaattccttcaacagtaggataccaaccaacattatccactgaaatgggtcagttacaagagcgaattacatcaacaattcgcggttcaataacctcggttcaagcggtttatgtcccagctgatgatatcactgatcccgcaccagcaacaactttttctcatcttgatgcaaaaacagttctagatcgaggcattgctgctttagggatttatccagcagtagacccactggcttcatcatcgcgggcacttgaaccaaatattgtcggtaaaaaacattatctagttgccaaaaaagttgttcagattttgcaaagatttaaggaattacaagatattattgcgattttaggcgtcgatgaactaagtgaatctgataaacaagtcgttgcccgtgcgcgaagaattcgaaattttttatcacaaccattcttcgtagcgcagaaattttccggaattcaagggcaatttataaaaattcaagatacggttaataattttgatgaacttttatcaggaaaatatgataatatccctgaagaagcatttttatatgtagggacaattgatcaagcacttgaaaaagcaaaaaaaatgggttgaagtgaaaaaaattagtcttaaaatccttactccaaaaggagtttttttagaatcaagtccttattcagtggcagtgaaaacaaaactaggttaccgaattgcccagtatggaattacaccttttgttggtgtgatttcctcctcaaatttgcatattttaaatgataatgaaaaaattgaaattccaattaaaagcggaattgtttatgctaacaaatatgaggttttgatttttagcgaggatcaattatcatctacctaatattaatttttttatggaaaatttcataaaaaaaggaaaaacagcttgtttttcccaattttttccttttttctgccaaaaagtgaaaaaaaacttaatatgttatatatgaaccacaaaaaccgcggaatgtttctcgaaaaaattattaacaacacaattgaattttactgtgaaaacggtattggtattttccataaaaaaaatttagatattagttttaaggcggttagtaaagatttagcagtcaatgatgcttttatttttaagaaatcaacagttgattattatggaatttataaaggaatttttgttgcttttgaggcaaaaagtacaaacgaaaatgttctaaatttaaagcaaatacctgaacatcaactaagttatcttcaaaaaattcgagaacattttggttgtgctttttttataatttttttcaaacaactagaaaaattttatattgtaagtattgacaaaattaatttatcctgaaaatctattcctgttgcatttttacaaaaagaaggttttgaaatcccgctaacatatccagggataatcgattttataggttatattgatcagatgatttaattttttagtttaatttgtaaatttaaagcagaattacaggtagtaattgtatcagaaaaagattaaattgtttttaatttttaatttttaattttatgatataatttaattcttaagctcagaataaataaaaatatcattaaaatggattcagttgggtgtgcttttttaagttctaactgttcgaaattttaagtagaaataacaaactaaaggaaaaatatggaaaaactagtaacacaacaagtccaaaatgttgatccaaagcaatccgaaatattaaatattagcgagattccagcggaaaatcctactgaaactcctattatttcaaaacaaaaattactcgaagctggggtttattttggtcacaaagcatcacaatgacacccaaagatggcgcaatttttgttaaaaaaaaagagaaatgaaacccacattattgacgttttaaaaacacaaaaaatgttggaaattgcctataaattagttgaaaagtttgctcaaaaaggagcaaaatttatttttgttggaacaaaaaaacaggcaaaaaaagtcatagaagaacaagctgtccgaacaaattctatttatgtttcaggcagatgattaggtggaactttaacaaataatcgaacaattttatctaggcttaaaacaatggaaaatcttgaaaagcaagcagcagaaaattttcaaggttatacaaaaaaggaaaaacttgcaaaacaaaaacaattagccaagttacaaaaaaaccttaacggaattaaagggcttaaggatgttcccctattttctctaattatgttagttgccgaccccttaaaggatgcaatcgcggttaaagaagctcgtaagaaagggataaaaattattggcataacagattcaaatgttgatccttcgttggttgattttgggattccagcaaatgatgattcgactaaatcaattacattaatatttacagttctagctgatgcaattgcttcagcaaaaggaggtaaaaaactttttgcatatcagtcagacgaaaatataattcttcctgaggatccagaaaaagaattaaaacaaactcgttaccgcaataattcatttgaaaaatttgctcgccaaaaaaatactttaaaagagagtcaagttttaaaaccaaacacagaaattcaagcctaaaaaataaaaataaaaatacgagaggttaagatgtcacaaattgataaaatggcaaaaatcaaaaaattaagggaaattagtgatgctccctttgttgattgtaaaaaagcattagaaaattccgattatgatattgatttagcaattaattgacttaataaaagcggaaaatcaaaagctttgaaaaaatcagatcgaattgccgctgaagggttggttttagcaaaaaaagatcctaattccgttttagtttttgagctaaattcggaaactgattttgttgcgaaaaatcaaaattttataaatttgcaacaaaagattggtgagttactccttgcaaatgattttacaaatttagaagacgccttacttattcaggatgaggcaggtaggccaatttcagaattattgattttagcaacagcaacaataggcgaaaaaattaccttgcgtcgcgtttttaaaacaaaatattctttagaacaaagtgttgaagtttatacccattcaaatggtcaaattgcagtaattacgattttaaaaggcggaaatttagaaatagcaaaaaatatttccatgcatgtagcggcattaaatccccaatatattttaaaaatcgaggttccaaacgagaaattgcaggaaattcaattagaagttgagaaaaaggcttttgctgaagttaaaaattttgagaaaaaaccagaaaatgttaaggccggcattttaaaaggaatgatagacaagcaactttcagaatttgttttagaacttcagcctttagcgactgacagtgctattacagtcgaaaaatatttagctcaaaattcagcaacattagaaaaagtagttcgttttgaggtaggcgaggggatccaaaagcagaatgttgatttttccgctgaggttaatcagcaaattcaagaatttcagaaaaaatagaaaaattatcaaactaaaaatctgaagaggggtataaaatttttcctatttttaaaggaaaagttttgtattttttataaacaaatgctagaatttttaactaatcgaattcagtcatccttaaaaaaattacaaaaatccataacaattaatgaaagtgatttagtcgaaataacacgtgaaatccggcttgccttacttgaagctgatgttaatttgttggtggttaaagattttatatctaaagttaaagcccaagtcttaaagcagggtttgacttcaaaattaaacccacagcaagaatttctaaaaattttacatcaaaatttactagaaattcttggaattaattcaaaatcaattaattttaacaaaactcttactataataatgttagttggccttcaaggttcggggaaaacaacaaccgctgcaaaattagcagtttttgcaaggcaaaaaaaattagcaaaaaaaattttactagttgcttgtgatacttatagaccagctgcaatcgatcaattaaaacagttaggaaaacaggttttaattgaggtgttttatgttgagaaatcaccagttcaaattgcaaaagaggccctaatttatagtaaaaacaatgattttgatcttgtaattttcgatacggctggccggctttcaatcaacgaagaattaatgaatgagctttcagaaattaaagaaaatattaaacctgatcaaattttatttattcttgatgcactttcaggtcaagacattatcaatgttgctcaaattttcaaccagaaaattaacctcacaggagcaattattacaaaattagactcaaatgcgcgcgcaggtgccgcgctttcaataacgcatttacttaaaattccggttttgctcgtcgggacaggtgaaaaaatttctgctcttgaactttttcatccaaataggatggccgatcgaattttaggaatgggggatgtaaggtcacttttagagcaagcagaggaaaatattgacaaaaaaacagtaaaaaaattatctcatcgaatgttttctggccagtttgatttaaatgatcttttaaatagtctagcccagattcagaaaatcggaaaattttcaaaaattattaaaatgataccaggtttatcaggaaaaattgatcaaagtcaaatagatgaagttgagaaaaagatgaaggtctataaaattttgatttcttcaatgacaattgaggaaagaaaaaaaccaaaaattttaaaaaatccctcgcgtcgaagtcgaattttgcgtggttctggaaggtcaagtgctgaatttaaccgtttaattaatgaatttgaatcaatgtcgaaaaaaatgtcagaaatttccacaaaaaatcttaatcttgactcttttattaaataaaaactaataattgttaaggattgaataatggccaaaattgaaaattacaatttttttattaaccaactacgggagctagggtttgtttttccaagttcacaaatttatggtggtctggcaaattcgtatgattatggtcatcttggtgtgcttttaagaaaaaatattgagaatttttgagctgatttttttgttaattcaaatcctaatgcattttttattgatagtaaaattttattaaacccgaaagtttgacaggcgtctggacaccttgataattttgttgatttattagttgaaaataaaattaataaaaaaagatatcgtgttgatcatctttttgaagaattttttcctgaggttgaatttgaaaaattatctcaggatgaaattcaggggtatttatctcaaattcaacttttggaaaatgcaaaagttgaatgagctagcccaaaaaaatttaatttactttttccgacctatcaaggcataatcgaagatgaaaaaacacttttatatttaagaccggagacagctcagggtatttttataaattttaaaaatcttctgcggacaacaaaaaatagtttgcccttgataattgctcaagtaggaaaatctttccgaaatgaaatttccccgggaaatttcatttttcgtacacgtgaatttgtacaactagaattagaaatattcttaaaacccgatcaatcagagaatttttttcaaaatgagattgaaaaaattaaaaactttttaaaaaaacttggttttgcgaaaaattcaatcagattaaactatcacaaaaaagaaaaattagctcattatgccaaggcaacagctgactttgaatacaattttaattttgggtggggtgaattgatcggaattagtaatcgtggtgattatgacctcaaaaaccatagtgagaaaagtggtgagaagcttgaatttgttgattcagctacaggaaaaaaatttttaccccacattatcgaaccttcgatgggccttgatcgtttaatgttggcggttttagaagaatgtttttgttttgacagtgtaaaaaatcgctattttttaaagctaccatttattctaagtccttataaggttgcagttttgccgcttttgaaaaaatttaattttttagcagaaaaaatttgaaatgaattaattagccaaaaaatatcagcaacactagtaacttccggttcaatcgggaaaagatactatcatcaagatgtgattggaacgtatttttgtattacaattgaccaaaaatcggttgaaaatagcattgtaacactaagattccgggatacaaccgagcaaaaaacactaaaaattgacgaaataactaaatttatcaaggaaaattttgttaatgaatagacaagaaattataacacatataataaaaaataccgatatttacgacctaatttcaaaaaatataaatttaaaaccaaaaggtcgagattcttttgtcggtctttgcccatttcatgaagatacaaatccgtcgttgtcagtttccttaaaaaaacaaatttttaaatgtttttcgtgccaaaaatccggtaatattataaattttgtaatgttgttacaaaatttaaattttttagaagccctgcaatttcttgataaggaatataatttaaaacttaagctaaattataccacaaaacttgaaaaaaattattcaaaagatgagcttcaagcattacgagcctttgaaaacgcggtttctatttatttagttgaacttatcaagattttctctttaggccagcagaatttgattatcgaaaatcctatttttttccagttatttaacttccttaaatcacgcgggattacaagggaaattatcgaaaaatttaaaatcggatttgtgccgacaaactcaattttaaaaaaatttttaattgattcaaaattttttgatggcgaggttttaatgaattattcacttctaactgttaatggaaatgatttttttcaaaaaagacttgtttttccgattgaaaattttgaaggaaaagtggttggattctctggtcgctgtttagatgataaaatatgtcaaccaaaatatttgaattcatcctcgaatagtttgttttcaaagactgaaattctttataattatgcaaacgcaataaagcaaaacccaaaagaaatcattattacagaaggattttttgatgtaattgctttttataaggcgggaattcaaaatgcagttgcactgatgggaacaactttgacaaaaaaacactgtgaaatgcttaataattttacagttttactcgcgctcgatagtgataaggctggtgtggaagctagtctaaaatcaggacttattctgggacaaaaccgtataaatacttatattttaacaggttttgaaggcaaagatccagatgaatatttcaatacttttggttcagaagcacttgttaataaactaagtaatcgaataaatagctttgatttcgcttatgatttttataagaattctataaaaaataattcaagtgaagagataaaaattttcattgaaaaatttagtccctttttagaaatattatatcaccaaaatctgcaattagcgcaaatttttttcaaaaaaattaaggaagattttggtatttcccaggatagttttaaatttagaccttcagttcaacattataatgaattagaaaataccttaaaagaaaatgaggaccaaattaaaagtattcacataaaaaaaacaactaatttatggctagcaaaaccgatttcaaccgaaattcaagaacttaaaattttaagtcaagttttagatgatattttataccatgacggtgaaaaatataatcgttttaaaggaaagcaatttaaatttctaaatccattaaataataaattaatggaagaaattaacatttttgggtataaaaatccaaaaatgcgggaaaagataaaaacaaaattaaaggaagtaaatgctgaattagaaaatttaatatttaaagatcgcatagaaaaactcataaacgaggatttaaattgaaaaaaagagaaaaatgccgatgatttagacaatttaatggaattaatacaaaaaacaagaggcagaaaagatgccgataatattcgtaaacttcaacttgataaagaaatgaataatgagtttgtgggcaagttctttaaaaaaattagaggtctataatcagaaaaaggtgggtgtttatgctaaaaaaacagttaaaattcccaaaacaagagagttttattgatttttcgttgctagaaaaaacgcagaaaacaaaaaaaattattgataaaaaagtttcaagtattagtgtagaagagataaaaatggaaaattcattaaaaaaagtaaatatagaagaaggaaaaaaaacagatttaacaagagaagatggaattaaaaagccaaaaaatacaaaaaaagcaaatcttcgtgagcgaagaaaaaattcatacgagcaaatcgaaaattttttcaacattatcaaaacatcaaaacaccaatcagattttttaaagaatttagaacaatttcgagcaaaaactttattgcaactatctcaaaatattaattcaactagtttggctcagaaatcaaaaaaagaagaaaaatctaaacaaaaaacagaaaaacagctaaattccaccctggtatcccccaaaaaacccgtaaaaaaagctaaaacaaattcagttaaggaaaaactaactaaaattatcccagtcaaaaaacctgataatatagatttacctaaaaaaataacagaaaataaagaacttttcccccaaaaagaggattttattccaatttctaatattaatcaaaatagttctgaatataattttattatcgagaaattagaacaagaattagaacaaaaacaccaaaagataggaaaaaatagttctaatttagataatttttctatttttttaagtcacgatgaaatttataaatatattgaaaagtgaaatcttgcaattgaagaagaaaaacttgatgatttttttcaaactttaatacaaagaaaaataattgctgatgaagtcgataaggaggatcttgaaaatgtttcaagttttgattttgccgagcaaattaataataaaaaatctgttagagataaaaaaaataaaaaatatagtcaagattttgatcagtcactaataaacttagatgatcaaaatttcgatattaatcataacgaggaagatgataattctgacctaaatctaggacaatcagtcgatgattccttaaaaattcaggaaattgacgacctggattatataacagaaaatagtccaaatcaataccacaaaccaaaagtttatagtgatgaagtttaccttaacaaactgaccgatacaagtgatatgataaaatggtatatgcgttggattggaaaatatggaaaacttttaacggctgaagaagaaagagaacttgcaaaaaaaatgaaaatcaaaggccggattggaaaaaaagcgcgtgataccttaataaaacggaatttacgtttggtggttaacagtgcaaaacgctataaaaaccgcggtcttggatttatcgatctaatctcagagggaaacctcggtattattaaagcagttgcaaaatatgactatacccgtggatttaaattctcaacttatgcaacctgatgaatccgccaagcgattacaagggcggttgccgaccaagcccggctcattcgaattccggttcacatggtcgagacaatcaataaaattaataaggtagaaagggaattacaacaagaaaaaggacttaatccaacagccgaagaaatttcagaacgtttagatggcgaatttagccctgataaaatacggtatattaaaaaaatcaatatcgatccaatttcactagataaagcaattgggaaagaggaagatagttcattttctgattttatcaaggatgagaatatgatttccccagtagattatgcaattcgtgaggaaaaagcgaaagttttgcttgaaatgatcgattcaacacttgattatgatgaaagagattttatcaaaagacgttatggggtcggaacaaacgatgaaggaattccttatcaggcccatagttttgaagagcttgcggcgatgcgtcgagtaacaaaagagagggttaggcaaattgaggcaaaaattctaaaaaaattaagaaccccacatcgccgcctatcattaagggattttaattaaaaagtaatgaaaacaaaggaagttggcgattttctccttgaaaaatttccactagaaaattgtcaaaattgggataagtgtggctgacaatttctttttgatactaaatttttaggcgcaactatttgtcttgatctgacaaatgatgtcctagattttgcactaaaaaacagttctaacttgataataactcatcacccattttttttctatcaaacaaaaaaagaggaatatgcctattcaccttataaaaaaaaacttactcttttacttaaaaaaaaattaattagcgtgatttcactgcatactaattttgattcaaaagaaaatcaaactgctttttcaataataaagcagtgtggattcgattttgaaaaaatcgaaaaaattgatgaattcaatattttgtttcaaactagtgcggattttaatgaaattttaaaaaaaatttcattaaatacaaatttaactactttccgcagcaatgttgaaaaaaatttttttccaaaaaaagtagcaattcttcctggttcaggcggaattttggcctgccttcaagcaaaaaaacaaaaagccgatttaattatcacctcagatctaaaatgatccgatcagataacattataccataaaaaaataaaagtcctagaaattccccatttaattgagcaggcttttgtctttgaaattgagcgaattttaaaggaaaaatatagcaaaattccaacctttacagttaaattagctgaaattttaaaagaaatgagattattatgataaaaataggctcccatgtaagattcagaaaacctgattatctttttggtgcaattcaagaatcactagaaaataaagcaaacactgcaatgatttttctaggacctccacagtcaactttccgagtcaagcccgagaattataaactccaagattatcaaaaacacttttttaaacaaattccgcctgaagatattattgttcatgccccttatattataaatccggctagtcctataaaagcacaattttctaatgattttttagtaaaggagatcgaaaaaataaactatatcggggcaaaatttttggttctacaccctggatttttcacaagttttactaaagaagtggcaaaaaaacagttaatttcatcactaaaatcaattttagaaaaaactaaaaatgtaattttattacttgagacaatgtctggaaaaggtagtgaaatgtgcgctaattttgaagaaattgttgaaatagttgaagcagttgaatcaccaagaatcggaatctgtcttgatacatgccatgtctgggatgctggatatgatcttaaaaattttcctgaattttgtaaagaaataagaagaacaaggctaattaattatttgaaagtgatccatttaaatgattctttaagcccactaggttcaaaaaaggatcgacatgctaatattggcaaaggttttattgggcttgaaagcttacgcaaaattatttttgacccactttttgctaatattcctaaaattttagagacaccttatgttgataataagcctatttatgatcaggaaattgcgcttttattaaaaaaagtttaaaatttaaaggtttttatgtcatatatagaaaaacaagaatttctcactgaattaaaaacaagaaatattctaaaggatatcagcagtcctgaaaaattttttaatctaaaacctgaccaaggaatttatatcggatttgatccaacagctacttctctgcatttaggaaactatatttcaatcagtctacttaaaagattacaaaaaatagggataaaagtacttgcagttattggtggggctactggaatgattggggatccatcttttagttcaaaagagcgaaaactacttgattttaagacacttaatgccaataaagagaaaattaaaaaacagttagagtcctttggtttgccagtttttgataattttgagatatataaaaatatgaatattcttgattttttgcgtgatgtcgggaaaaatatcaatatttcttatcttttagccaaagaatcggtggcttcgcggatcgaagttggtctttcttttacagaattttcctaccagttgattcaaggctgagattttaaatttttagcagaaaattatcaaataatcggtcaagctggtggttctgatcaatgagggaatatggttactggtcttgattttatcaaaaaatcaaatttagtccaaaaagatgaagcttttgtgtttacaactaatttattaaccgacgaaaacggccaaaaatttggcaaaagtttaggaaaaccaatctggcttgatccagaaatgtattcgccatttcatttgtaccaatttttattaaatcaaaacgatgagcaagccgaaaaaattatgttgtggttatcttttttagatctaaaagtaataaatgagctaattttcaagcataaaaatgataaaaaacaacgtattttacagtataatttagcacaagaggttgtttttaatatccatggagacaaaggcctaaagatagctaaaaaaattacaaaaattttatttgaaaaactagattatacagaaataacatttaaagataagttagaactaaaaaaaattatcccgtattttaaagtatcttttttcaatgccaatcaaataatcgaccttggaatatttaaatcaaagcgtgaattaaatgaatttatttctcataaagctcttgaaattaatggatctaaaatctcaaatattggtgatataactgaagaactaaaagataaaagcaatttatttttgcttagaaaaggcaaaaaatacttttttatcatagaacttatttagtgtttttttctaaaaaaacatttataatattcatacatattttgaaaaaagtatttttttttaaggaaattttatggaagttgatagtgtttatgaaaatcttaagaattgacaaaataaattattagatatttcaaagaaaaaccgcctaattaattttaatttatttcagccaactaagtctgttccactaaaacttggtattttatttcctgattttaatcagtttttagacaatattattgaaaataaaacaactttatttttcagatcgcttgatcaacaaaaaaaagcatctaaaaaaaacagccataaattaagtgattttttgcctttaacacttgagcaacttcaaataaatacaaaaatttcaaaaattcctccaaaagtaattatttcggattttttacttgaacaagaacaattaataattaaaaatttatatcaaaaatcaaaaaattataaagaagaaaagtcaataaatattctttatttagggataggatttttaaaatgatacgaaaatactgaggaaaacactcctatttatagtcctatttttttatttcctgtccaaattaaccgcttgatttttcaaggaaaagaaacaatttcgctagaatttctcgataatgcctttctaagtataaattttacgcttctaaaaaaactgcaaatcttaggactagatactaaactttctaaattcagaatcgataattcgctttcgattaaggaaaattacaataattttaaaaagttattcagtgaaggtaataacttatctaactgagaaatgattgagaccatccagttaagcgcttttgactatagtaaaattgaaatttatactgatttggttgaaaaccaagaaaaaattattaaaaataatttttatacagaaataaatggaaatttttttggttcagattctttaattaaaactactgacgaaaccaaaaaaatcaaaaccgctgatgaattcaataacatcaacccacgcgattattttcatattttagaagcagattcaactcaagaagcagcaattcaggcggcgataaaaggggaaaattttattttagatggacctccaggaaccggaaagtcacagacaattactaatataatcaacgaatttttggcaagagggaaaacagttttatttgttgctgaaaaactagcggcactaaatgttgtttattcaaaccttaaaaaaattggattatcagattcggtaattgcgattcataatgaaaatataaataaaaaagaaataatcaacgagcttttaaatactttagaaaaaggatcaaattcaattttaattaataaggttgaaagcaacctaatcgaaaataattactctgaattacagcgaaaattgaatgattatggtgataaattaacaaaaattcgtccacagttatcaaaaagtttatatcaattaatagctgaatatcagaatcttgccgatttttctagttttgatttttatttatctgaggaaaaaattaggaaaattaactatgaaactctacagaaaattcaatgagctcttaataatttgtttcaaaaattaaaaaatattaattttaatttaaaaaaacatccttgatatggttttaaatcggcacaagttgatgaatttgaaaaagaaaaatttagaacttggttattagaattaattaaattaagcaagctaatttttgaaaatattaaagaatttaagttttttttaatgcattctgatcaacatcttagcaatattataaatttatcagaacttctagaatccttatataaattaacaaaaatcgatttagtaggcttgcaagaaattgaagatttatcatttgagatagaaaaatatagtcaaattaaggaaactaaggcagaaattattagccttgaagataatctaaaagtttattttaaaagaattccgctaaatattccgcttttggagtttaaagaggttattgaaactcaccaaaattccaggataaaatttttggactttaagtataaaaaaattaaaaaaaccttatctacttatcttaaagatggttatgagcctgaaatttttcttaaaactcactcattaattcatttattaattcaaaaaaaattattgttatcaaaattagttgagagtctcaaatttaaattaagtctgaattcagaagaagaaattgaaaataatctttgacagctgaaattttatgtaaaattaaaatttttaaataattcaacaaaaattaaggttcaagacaaagaatttgttgactttttctttgattcaaaatacacaaaagaacttttaacagaaaaattattttccccagttattaaatttatgcagatatgaaaggaatttacttcatattttgattctaaacagtttgattttttgtttcttgaaaagaaaaaattcgaggaaaacttacatcaaaagtttgtaaaaatcgaccaaatttatgaaatttcgcggattaatactgatattaatgcgctaattcaattagaaattgatgattttgtaaaaaaagtaatagaaaacaacattcagcaagatttttataaaatttttactaaaaaattttataaattattaattaatcaaatagttcatttggaatttgaggcttttgattgacaaactttgcatttaaaccaaatgcagtttgaacaagcccagaaaaatttagaccaattaacccggaaaaaagttgattcaatccttctagaaaaaattccgcaaattgactctttttccgataaaaattcagaaattagaattttaaaacaagaagcaaataaatctcgtcgcttaatgccttttcatgaactttttgtccgaatacctaatctgttaaaaaaattaaaaccttgccttatgatgtcgccacttttggttagttcatattttaaaaatagtgatattgtgtttgatcttgtaatttttgatgaagcctcgcaactaaaaccagaaagtgcaatcggcgcaattatccgcggaaaacagtatataattgcgggtgataaagagcaaatgccccctacaagtttttttgatagtctttctgaagatggagaaaataacgaagatctagcagaatttaatgtttctgattatctttcaattcttgatgtaagccaaacttttttaaaatcttatagattaaaatggcattatcggtcaaaatttgaagagctaattcaaccttcaaacattgaaatttataataatgatttaatgacttttccggcaatcgaaaggccacaagaatttcaaggaattaaattttttaaagttgaaaaggcagtttataaaaatcgtagaaatgaaaaggaagccgaaaaagtacttgaagtccttgcagaaatttttcaaaaatatcaaaataagtttacaattggagtcgttacaacaaatcttgaacaggaaaaattaattgctgggaaaattgataggtttaaggcagaaaatccgcggtattttcaaggtatatcagaaggtatttttgttaaaaatattgaatcagttcaaggtgatgaacgagatattatcattttttcactgaattttgggcctaatccagagggaaaaatttctgctaatttcggagcaatcaatcaaaaaaatggttatcgccgtttgaatgtcgcttttactcgcgctaaatattcaacagttgttgtttcttcaattgaaccagaacaaatcgatctaacaaaaacaaaagccaggggcgctgtttttctaaggaaatatttagaaattgccaaatatggcgttcaatttagtactcaaactacaaaaaccacatcaaatgaagtaacttttgaatctattgtttataatgaactaaaaaaattaggttataaattattaaaaaatgtgggttattctaattataaaattgatttagttattttaaatcctgaaaatgaagatcagtttttgctaggcattgaatgcgatggttcaatttttgcaaaactaaaaaacgcgagggatcgtgatattttaaggaaaaaagttcttgaatcgcgtggttggaaaatttttagaatttggtcaattgattgatttcaaaatcccaaattacaaataaaaaaaattaaagaacaattaaaactaataggaactaaaaaagctgaaaaaagccaggatgtgttagccaaacaaaacaaaactaatgaaaatttgattttaatagctgaaaaaccaaaaaacgatttcagatccgcatttcaaataagatttaaattggattttcaaaatttaattaaattatatgataaaattaaagataaatttagtttattaatctatatttttgaaaaagttcaaattttacacaaaaatgaattttataaaattgttgcctgattagatggtaagacaagaacaagtattctaactaaacaagaggcacttaaaattgctaataatctgataaaaaaaggtataattttcgaatcacaatcacattatttattaaaaaatgttgtgaattataattttttctttcaaccaaaaagaccaataaaggaaattcactatttcgagattaaagatttgattataaaaatagttcaacacacaaattcgataactaaagccgatttatataacttaattttagaagtcactcatttcacaagcctacaaaacaaaactcgcgactatcttgatagatgtcttgaaaaattaataagtgaaaaattaatttttattgatagatatagcaatttaactttatagccctaattgttttgttcatttttctattactaggttgataactttttatgctaaaaaaagttgtttttatatcatttgtggtataatttatgtaattaaaaaaggtgggtatgatgaaaaagacgctgaaattaggtctacaggtaagccttcccattatttttttctccggaattattacagccggtgttttttttcaacctcaaaaaaaagccaattttcctaaaaatttttcaaatgagataaaaaaaccattattaaatgagattaattatcttgctcttggtgattttttaagcactggatttgattgaaataacaatcttgatggtcggagtaatatggtaaatggctcaattacgggaatttcttttcctgctttttttgttaattttgcccaaattattaagtctgattccgttaagtcatttaaaaatttagccttaaatgattcaggaattttggactgattatattttttggagccaaaaaataattttcttgataaggcaagattgaataattttaaagcgcaaatttacaataagtcccgattcacagagataattaggtcggtttttggggattttagttctagttttccaaaattaattgaagagataaaaaaagcaaatttaattagtatttcacttggatttaaagattttttagatgcatttaattctcaattttttgatgatcttaagctttcaagtttaaaagaaaatagaaaaaacactgattttgtgctaaaagtagacaaaattttcacaagaattgaggcaaatttagaaagaataataaccattatcaaaaaaataaatcctaaagctcatataaatttaatagaatactatcaaattcagccaaaaatccaaaaatatttacaagatttagccgaaaattatttaatagaaattaatgataataatctttcgatttatcgattgaacaaactaatccaaaaagtagcccaaaaaacaggggttaattatataaatccttttagaggcgttaattctaaggttggtgatgaattttattttgatagtcatatgaattttcgcccgcaaattaagggaagtaagcaaattgcgcaaaatttaattttatcgttaaccctaggtaaaaaccaaataaattctctatctgaatcaaaagatcgcagaattcaccaaactaatttttctagcgatttaaatgaaaaccaacaaattaatttagctccagataaagaaattttagaaaaactatcgcttaatggttcattgctaaattttgtaaaagctgattcaaattttgaaaaggaaagcattcaggcattgcatacttttaaaaaagaggaaaaaactaatttttctgcaaaggattttctaagtaaaattactccacttcttgattcacagcaaagtccctttgtaaaattagtaaacgaaataattgatacttttggcaatgaggcaaatcctaattttgaagcatttaataatattattgacattattttcaaaagtaattttgtcacaaatcttcttcaggtcgcccaaagttatttatttaattcctcacctacaaaccagacaaattctaaaactgaacaaaaaaaacccgatttacttacttatttaaaatcgaccgttttaacagaaaaagaaattgttaagcttttaattgaggttttagcaagcccctatgttcaaaaacaccaaaatgaaactattagtttattttataatctatttttccggcaaaaaaagattatcaaactaattattatttcatttaccaaagatccagtttatcaggaaattatcagtcaagttttagattttaatactcttcaaaaatttgtaatttttattttaacggaattaattaaaaataacaaggattattcaactgttagttcatttaaagatttattgttgctgtttttgcagaattcaaataattataataaatcaatcacttttatccgaaattttgtaattgaagcattcaaacagacagattttctaaaaaatgttttaaatttattattaaataaatgaagttttagtataaatcacgacgatcaagcttctttagtatctctaatttcaagcatcagcgacatattgacaagaacaaaaacttttaaaaatttaattaatttaatatcaagggaaattatattaggacttaaactaaatagcgaaaaaaatagcagtaatttaggatcttttttagaaattttaacaaatttgcctcttaaaattcaaaatttttttaaggaaaaagataatatttttaattcatcacaagatattttacattttagtccttctgtcagacagttagatgcaataaaagcttttattgataaaattttaccttttattaccaagataaaaatcaaactaacagattttttgggcctagattcaaataattttacagaaataaatttagtttttgaagcttttgtaaaatttttatcagaaaataattttcagcaactatccaaattaatcaaagcttttcttgagagtttttttgtaattgatagtttaaaatatcggaatagtttggattttaatgggataatttttaatttaataagtaataattccgagataataaagcaaattttcttggattttgtaattaccaataaaaataatacgcaaattttaggtataatttcctcaatatttttaaaaatgattaataataacgcggtaaaacaccttcaaggccaggaaacaaacacatttgatcgtataaaaatttattatttaattgatacatttttactaaaaattaaggaattaacaaatcaatataatattaatattgcagaaattaattcaaaattagcagattcaaaaaattccttagaatttcccgagttaattaaaaaacgtgagaatttaaagacctttttaaatattaataagcttaaaaattaaattttgttaacttatttttttcaaaaagataacaaaatttaaatgctgaaatttgaattattccttagaaaataaactttttatttgttttttcttcattttttccttaacaaataaatcgacattttcttgaattaaagcaaagaaattaagaacttcttgagctaggttaatttttttaccatttaagtcaataattttttcagttttatgccttttattttttaccattccaaaaatcggaatttcaaagtgattttttcttaaaatttctataattaaattaatttgttgaattcctccatctactaaaatcaaatcaggttttagaaattttggatttttaatatatttttcaaaaccctgtctcatataatttgtatcacctttttttgttcccctataattgaaaaatctattgtaatttcgctcatatattccgtttatatagaaaataattccagttgtggggtagtttgactctaaatttgagcagtcaattgccataattttttcaacattttcaatttttaaactggttttaactagttctaaaattttctgatttttaatttttttcttaatttcttggtcaaaattatggctgataaaatcttggtgattttttgctaaagtgtttaaaatatgcttatattttaagctttttccaattttgatattaatttttgggtctaaaaattcagcatttttaggccaaaaatttttaactactaactcatcgggataaatattaattttataataattatttaaaaaattaattaaaacttctgtataattaagtataatatcaataataaaatttttattagataaaaaaacaccattgcgataaaaagcaaaactaattactaaattattctcgccaatttcactataataaagaaaatcaatattttttaggttgttaagctcaatattttgttgttcaattttagtttttttcagtgcaataagcgctttgtgatattcgttggcgagttcaaattggttatttttctttgctttttctaatttttgttcgcaaaaactaattaatttttgttcctgtagtatttttttacataaaaaaaatttttgatttaaaatttctggttctgattgtacaatttgttgtccttttttgtataagacaatattttctaatattttttttaggaccaaagcgctgcttttattaagaaaaggcccataaaaaaagatattttttgactttttgctgcgtgaaattttataaactagttcaatattcagttttttttctaattctaattttatatagggataattttggtcatctttaagtttaatattataaattggttggaatttgcttatgatttttttttctaaaattagtgcttcggtttcgttttggagaatatcatatttaatttctttagtttttctaattaaaacttcggttttataagaattagttgctccttttgcatactgattcattcgtgattttagattcttagctttcccaacatataaaagggtgtttttttcatcataaaaacggtaaactcctacctggtttggcagcatcaattttttaactaattcctgaaatttttccatataaaaattttaagttcttaaaatataaacaaatttttgataattattataattttaacaaaaaattggtataattaaatcttgaagttaaaataaattagagtgagattttttaaaatggattttgaatcatataaaaaaacttctgttcctaaaatgaaacagttgaaaaaacatggaaaaattttcttagttgttggaattatttttttgattttttttattgctttactcactttttatttagttaaacaaaatgacggcggcttgccaaatgattttatcgattcaacttgacttgcagttagtttgttgtttttggtaattagtattgcttttttggtgttttttgggatagttatttataaaattaaggctattaaaaaagttgaaagacatatcgaaactcaattaaaagaattatagctattttaaaaaaagtgaaaaaaattataataaatttttatttctagttaaaaattatgactatttttcataaattctggcactttttaactttaagtgccaaattatggtatactttcttttgtctaggaaaataagacaaaataatactcaaaattcaaaaaaattagagaaaggataccaaaaaatggcaaaagaaatcattttaggaatcgaccttggaacaacaaactcagttgttgcaattattgaaaatcaaaaacctgtcgttctcgaaaatcccaacggaaaaacaacaactccatccgttgtcgcttttaaaaacaatgaagaaattgtcggggatgcagctaaaagacaacttgaaactaacccagaagcaatcgcttcaattaaaagattaatgggaactgataaaacagttcgtgcaaatgaaagagattataaacctgaagaaatctcggcaaaaattcttgcttatttaaaagaatatgctgagaaaaagattggtcataaagtaacaaaagcagtaattacagtacctgcttattttgacaatgcccaacgtgaggcaacaaaaaatgccggaaaaatcgctggattacaagtagaaagaattataaatgaaccaacagcggccgcacttgcttttggccttgataaaactgaaaaagaaatgaaagttcttgtctatgacttaggtgggggaacttttgatgtctcagttttagaattatccggtggaaccttcgaagttttatcaactagtggtgataatcatttaggtggggatgactgggataatgaaattgtaaattgacttgttaaaaaaatcaaagaagaatatgattttgatccaaaaagtgataaaatggcgcttacaagacttaaagaagaggctgaaaaaaccaaaattaatctttcaaatcaaagtgtttctacagtttctctaccatttttaggaatgggcaaaaacgggccgattaacgttgaacttgaacttaaaagatcagaatttgaaaaaatgactgcccatttaatcgatagaactcgcaaaccaattgttgatgctctaaaacaagcaaaaattgaggcttcagatcttgatgaagttctccttgtaggtggatcaacaagaatgccagctgttcagtcaatgattgagcatactttaaataaaaagccaaatcgttcaattaatcctgatgaggtagtcgcaattggtgctgcaattcaagggggggttctagctggagagatcagtgatgttctacttttagatgttactcctttaactttaggaattgaaactttaggtggaattgcaacacctttgattccaagaaatacaacaattccggtaacaaaatcacaaattttctcaacagctgaggataatcaaaccgaagtaacaatttctgttgtccaaggtgaacgtcaacttgcagcggataataaaatgttaggtcgctttaatttatcaggaattgaagctgctccacgaggtcttccccagattgaagttagcttttcaattgatgtcaacgggattacaacggtttcagcaaaagataaaaaaaccggcaaagaacaaacaattacaattaaaaatacttcaactttatcagaagaagaaattaataagatgattcaggaagccgaagaaaatcgtgaagctgatgctcttaaaaaagacaaaatcgagacaacagttcgtgccgaagggcttattaatcaacttgagaaatcaataactgatcaaggtgaaaaaattgatccaaaacaaaaagaattacttgaaaaacaaattcaagaattaaaagatcttctaaaagaagaaaaaactgacgaattaaaattaaaattagaccaaattgaagcagctgcccaatcttttgcgcaggcaaccgcgcagcaagcaaatacatctgaatctgatccaaaagctgatgattcaaacacaattgatgctgaaatcaagcaggattaaaattttttcggtataaaaaacgcacacttgcaaatttctgctagtgtgtcttttttatatttatatagttaaataacttctaaaaatggaattttcacttaaaaattccttaaattttccggttttggaatttgatcaaacaggaaaatttaataaagcgggttgaaaaaataaaaaaaactttaaaaaaagaaaaataaggtataatttatggcaaaacaagatttttataaaattctgggagttgaaaaatcagcatcactaacagaaataaaaaaagcttatcgaaatttagtaaatatttatcatcctgataaaaatacaaaaaaatcagctgaagaacaaaaacaagctgaggccaaatttaaagaaatccaggaagcctacgaaattttatctgatgaaacaaagcgaaaacagtacgataaattcggtcatgccgcttttgatcagcaatttggtggtgggtctagtggcttttcaggatttgattttggcgatattttttcaagttttacctctggttttggttttggcggctcacaagaacaaaaatatagtcgtcctttaaagggcgaaaattttcaagctaaaatttatatcagttttatcgagtcaattctcggaaaagaaatctcccagaaattaacaaaatacgatcaatgtgataactgtaagggttcaggcgctaattcttcttctgatattacaacttgctataattgtcaaggtcggggaatgcaaactgaggtcttaaatatcccgggatttggtcgggttcaaaacaaaacaacttgttcagtttgtttaggttccgggaaaaacattacaaaaaattgcaaaaagtgccgtggaaaaactatagttgagacaaaagaggaagtaactattaaaattccggccggaatccaggatggaatgtttatccgcgtggccggatttggtggaccgggacacaaaggcgggccttctggagatcttcatcttgagattaatgttcgtcagcataaacattttactagatcaggaaatgatattcatgtgaatatgccagtttcaataattgatattatcaaccaaaatactgtcgaggttcccagcccaaccggtttgaaaaaagttagactttatgattattataaatcaggtcaaattgttaatgttcttcgtgctggggctcctgatccaaaaaatccaagaattattggcgatctcaaggttcatttaattttttatatccccgaatttagtccccgtcaaaaagatgagctcaaccaggtttttgctcaaatcaatgataaaacaaaggcaaaatgactaaaagaatttcaataatcggaaaaattgtttataattttgtataaaagttattaacaggaactacttattataaatgccttttaaaaaaattaatattgcaatcgatggaccttctggagttggaaaatcaacaattgcaaaacaaattgcaaataaattcaattatttatttataaataccggttctttatatcgcgcaattgcttttttttgtcaaaaaaatcaaattagcattacaagtgagcggaaaatgataaagcatttgccaccaaattttttatcacttgattttgaaggaaatgtttgactacaaaatcaaaatgtttctaatctactacgcaatgatcttatctcaaaaaatgcagctatcatcgctcaatacccacaaataaggaaaattgttactgaaattttgcaaaatttccaaaaaaatcataaaggaatcatcatggagggtcgcgatacaacttataatgttatgccagacgctgatctgaaaatttttttatgagcagatgcagagacaagagcaaaaagacgtttaaaacaaaacacttttttgaatttagaaacagattttcaagaaattttaaaggcaattgaacatcgcgattaccttgatatgacccgaaaaactaaccccttaaaaaaaacagttgattcaatttttcttgatacaacaaattttacaagagatcaaattgtatcccagatttccaagttagtttttcggaaaattggtcagttttcacttgaaatttaaaggttaatttttaattaatgaaaaatttagttgctcttgttggaaagtcgaacgttggaaaatcaacactttttaaccgaatagcaggcaaaaaaatttcaataactaatccacttccaggtgttacaagggatcgaatttatcaaaatgtgacctgaaatcaacatagttttttgttaattgatacaggcggaattcaaattgagaatgaaaattttcaggatttagtcagaattcaggtccaaattgcccttgaagaagccgatattttagtttgagttcttgatggtacaaaagaaattgattcagaggatcattttgtccttagtttattaagaaaatccaaaaaaaaaattattttagttgcaaacaaacttgaaaacaacaaatcttttgatataagcctttttgagttaggttttgagaaagtttttccaatttctgccttacacggtcatggagttggtgattttttagatgaacttgtaggtaattttaacaaaaaaaattttaaaaatgagattttttttaaattaactctaattggtcgcccaaatgcaggaaaatctagtctccttaactgacttttaggggaaaatcgttctattatttcagaaattcccggtacaacaagggattcaatttctggtttttggaaaataaatggacaaactttggaaattatcgatactgccgggattagaaaaaaatcaaaactggcagaatcagttgatttttatgcatttttacgagcttttcgctcgcttgatcaggctgatttaaccttgattttattagatgcttgtcaggattttcatcattttgatctcagaattgccggttatgcctttgagagaaataagccgataattttagttataaacaagtgggatttaattcaaaaagacacaagaacacaacaagaatatcttaggaaaattaaaggtaagtttaaatttcttgattgagcgccggttgttttcatttcagcaaaaacaggagaaaaaattcataaactcattgatgttatttttcaagttaaaaataatcttgaaaaaaaaatttcaacaaatttacttaatcaatttctaatggaaattcagatgattcaaccccatccaaatgttaatggtaaaaaagtttacttcaactttttagagcaaatttatggaaaaattcccacttttatattttttgtaactgataaaaatttagtccatttttcttatcagcgttatattgaaaaccaaatgcgcaagtattttgatttttttggctgtccaattaaaattatttataaaaatattaccaaaaaataagaaaataaagtaaaatttataattatcttagttatgaatggagtcattaaaatgaacaaaaaagaactaattgagcaaattgcaattaaaaccaatcttcctataaaaaatattgagcttgttttaaatgaattttttggaataacagcagatgttgtcaaaaaacaaggaaaattagtgattaactcttttggaactttccaaggagttttcaagcccgcatcttcttcatttaatccactaaccaaaacccagattacagtcaatgcaaaaacaacagtgagattcaaaccttcaaaagttctaaaagattttattgcctaaaaatgtttagaaaaaagcaaaaaaagccgaaatttaaatacaaaaccgcaaatcaagtaatttatggaaatgtagttttacaaaaacttaaagagattaaatacgggaaaaaaatagcactttttctccttttatttctcctggttgtcggccttgttttaggtcttgtttttcttattttttattttgcagatagcggaagtaacattgaagaaatagttagtcgtgggtagatggataataaaaaaattcgaaattttgccataattgcgcatatcgatcatggtaaatcgactttggccgacagaattcttgaatttaccaatacagtttcaaaacgtgatctaaaagaacaacatcttgattcaatggatcttgaaaaagaacgtgggattactattaaactaaatgcggtccaaattcgttataattcttacatttttcatctaattgatacacctggccatgtcgattttacttatgaagtttcacgatctttagcggcaactgaaggcgctttgcttttagtggatgcaagtcaagggattcaggcacagaccttggccaatgtttatttggcccttgagaataatttagaaattattccaattataaacaaaatcgatttaccttcggcaaatgttgataaagtcaaagccgagattgaaaacactatcggaatttccgctgaaaatgccattttgatttcagccaaaaatggcatcggtattgaaaaagtacttgaagcgatagttaatttgatcccgccaccacaagcttcagacgaaaaagatcctttaaaagcgttagtttttgattcttattttgatatttaccgcggggtaataatttttatccgtgtggttacagggaaaatttcagtcggggatactttcaaatttatggctaataacttgaaattttccgtgattgaattaggaatttccagtccaaatcaggttaaaaaagaggcgctttttgctggtgaagtcggttgggtggccgcctcaattcgcaatgcaaaagatgttgaggtaggtgatacaatcactttagttgaaaatccggctaaatctccacttcctggatataaaaaattagttcctgtaatgtatactggattttaccccgtggattcacagcaatacaatcttttaaaagattctttagaaaaaatttcgctttcggattcatcaattatttatgaacctgagtcatcaaaagcgcttggttttggttttcggattggatttttgggacttttgcatatggaaattcttcaggaaaggcttgaaagggagtttaatctttcaattatagcaactgcaccttctgttgaatttcagattacaagaacaaatggccaagtccagataatttctaatccgagtttgtttcctgaacctaattttattagtgaaatcagagaaccttatattttagcgaaaatttttttacctgaagaatttttagggcaaattatgggactttgtcaagataaacgcggaatttatgttgatcttgaatatatagatgactttcgtaggcgcttaatttataaattaccgctagttgaggttatttttgacttttttgatcggctaaaatcactttcaaaaggttatgcatcttttgaatacgaggtaattgattatcaagtttcaaaactgcaaaaattggatattttactaaatggacagaaaatcgatgcactttcaatgatagttcataaagattttgcctatccaaaagcaagagatcttacccaaaaattaaaggaaattatcccaagacattcttttgaagtcccagttcaagctgtaattggatcaaaagtgattgctcgcgagacaattaaagcttatcgtaaagatgtaacggcaaaattatatggaggggatgtcacaagaagaaaaaaattacttgaaaaacagaaggcaggaaaaaaaagaatgaaatctttcggggtcgttgatgttcctcaggaggcctttttagcaattttaaaaacaaatgttagtgaaaaatagtgtataatttgagaaaaataggtgaaaaacaagcaaaaattcttttttttactttactaggttaataaatatgagaagaaatagacaaaaatttgaaaattacccctaccagcgaccacaaaataacccaaatttttctaattttgagcaaaaaaacaaaaattttcaacccacacaacatgaatatcaatataatgaagaaaattatcaggaaaattcccgttataggccaaaatatgaaaatacttcgcaattttatcataatgaattattagaacgcgaatatcaagatagaatggaacaaaaacgcattcaggaagaagcgaatacctttatttcaaaagaggttcggaaaatttttggtttagagttaattttcctacctttaaaagcgattttttgactagcattgattcttacagttttaattgtttcagttctttggactcaggaaaaaattccagcttgatcttatgagaaaaaatatttacctttgctaatagtccctggaatttttggcgctattttattttttctttttattaaaacacttttagactataaagcaatcaaaaaatctgttatttattttcgttcccagttgcaaaataatgcaaatcgacttgaaatgccaccaatgattccatgacttgtaaaaaaagtgaatcaaaaagaggtaaatgctatctgacttagcggctttactttgtttgcaacaattatgatgggcttaacttactgagtgttattaaaatattatccggagaaaaatattcaaaattctgccgaatatataactgcaatggcagtaaatggcgctttgtttatagttatgctaatttatgatttaatgcttcgtcggcgtttgggaaatattgaagcaatttttggtcacatttatcataaaagtattgatataggtaaaattcgttttcgccgtcatttactttgagcttttttaacggtagtaatttttttgattttacgaagaatcggaaaacgtaaaaattgaatttagatatattttaccctatttatttttttctccaagtaaaaaataaaaatttttttaactttataaaaagcacttaaatttaagcgcttttttatatttaatagcaaaaataattattaattaaattattatgccaagaatattacaaaaattttgctagccggaaaagttacataaattacgatacttttttaaattaaataagattaattctaataaattgtataaaaaaccgagtttttagaaaaaaatgaaattaattcatctaaaaactcggttttcttaatttttcgatatttttttatagttttctttttttagtcatcttccttaattgctctttgttttacgatgacatcggaaatatttttgggtacaatttcatagtgattaaattgcatctgataggttccccggcctgaagtcattgaacgtaattgcgttgaatacccgaacatttctgcaagtgggacgtgtccgcgaattacatttgccccatcagaacgagtttcctgttcacgaactagaccacgacgacgtgataaatctcccattacatctcctgcatattcagagggagcaaaaacagaaacatccataatcggctctaaaagtactgttccaacagcatctctggcgcgggaaagtgccttagatgctgcgattttaaaggccatttcagaagaatcgacttcatgaaaagaaccatcaaataaagttgcccttaaattaattaaaggatagccagcaagaattccggcttgcattttttcttctagtcctttttgaattgatttgatatattcttttggaattttccccccaacaattttatcaataaaatcaaaaccttcttcaggattaggttcaaatttaatccaaacatgaccgtactgcccacgaccaccggattgtttgatatattttccttcaacttcagcgctttttgtaattgtctcgcgataagaaacctgcggttttcctacacgagcttgaacattaaactctcttttgagccgatcaacaataatatcaaggtgcaattcgcccattccggcaattattgtctgtccggtttcaatatcagttcaagttttgaaagttggatcttcatttgctaatttttggagggcagtagctaatttttcaatttcggcttttgaaaaaggttcaagtgactgggaaatcacaggttcaggaaaattcatcctttcaagaacaaaagtttttgctttttcggaaattaaagaatcaccagttgttgtatcttttagaccaacaaaggcaccaatatcaccagttcttacctcatcaatttcttcacgggaattagcatgcatagctaaaatacggcctacacgttcttttttgccttttgttgagttaattatataagtacctttttttaaaactccagaataaacccggaaaaaagtaagtgatccaacaaaaggatcattcataattttaaaagcaagggcagaaaattcttgatcatcgctagcttcaattgtaatttcttcctcatcacgaaacgctttaattgggggaacatcaacaggggaaggtaaataatcgataaccgcatcgatcatctttttaacacccttgtttttaaaggaagatccgcagacaacagggaaaaaattacctgtaattgttgcagcccgaattgcagcttttaattgttcaggtaaaatttccttttcttctaataaattattaaaaatttcttcatcatagtcagcaactgcttctgcaagtgcaagtcgcatttgacttgctttttcgaaaagatcttcaggaattggaatttcatattcgatttcttctttttggccatcataattataagccttcatttcaacaagatcgataagtccactaaaatcggcttcagcgccaatatttaactgaattgcaactgcattcccgtttaattttgtccgcactgattcaattgaagcttcaaaatttgcaccagctttatccattttattgacataaacaattcttggaacgctataatttgttgcttgtcttcaaacagtttcagtctgaggttcaaccccggattgggcatctaaaacagcaactgccccatctaaaacccgtaatgatctttcaacttcgacagtgaaatcaacatggcctggtgtatcgataatgttaattctttttccttttcaaaaagcagttgttgctgccgaagttatcgtaattccgcgttctttttcctgttccattcagtccatttggctaaccccatcatgagtttcgccaattttatgaatttttcctgtatggaatagaattctttcagttgttgttgttttccctgcatcaatatgggccataattccaatattgcgataatcttttagttcaaattttcgtgccataattctaaattcctaccatttaaagtgggcaaaagccctatttgcttccgccattttgtgggtatcttcttttttcttaaaggcccctccggttttattataagcatcaattatttcgtttgctaacttaactatcattgttttttcattccgtttacgggcaaaaagaattaatcagcgcagtgcgagagtttgttgtcgtttctgtcttacctccattggcacttgatagttcgttccgccaattcgacgagaacgaacttcggtaagcggtgttacatttttaaccgcctggcgaaaaacttcaagtgcatctttttgtaacttttcttctactaatttaaatgctgaataaagaatgttttgagcggtggtttttttcccttctaacattgtgcaatttattgcttttgttatcagtttggaattaaaaactggatcggctaaaacattgcgaacgggagcctgtttttttcgtgacattttatctccttttttaaaaatatgttgtaatttatagtatttttttattttttactttgattttttcggtcttttagccccgtattttgaacggccttgcgatcttttggcaaccccagttgtatcttgggttccccgaacaatgtgataacgaattccgggtaaatccttaacttttccaccgcggattagtacaattgagtgttcttgtaaattatgaccttcgccaggaatataagcattaacttcaattccatttgaaagttttacccgagcaaattttctaagtgcagagtttggttttttaggtgtcatcgttgcaactcttgtacaaacaccccttttaaaaggggcgcttaattttaactcctttttatgcaaagagttataaagcatattaagcgctggaactttagattttcaagtttttttaacgcgacaacctttagctaattgtgatattgttggcattttttcctttattttatagtgttttttgttttagaaaacaacggtatcggtgatatagaattaagatctataaatgcttttaacaagaaaatataaaagaattttaccacttttttaaattattcaaagcctaattttcgatttttatatccattagttctcgtgctaactgttctaaatttatttctttttcatcaagctcttttcttttagtttcataaaattcaagtttttggcttgcctttttataaacattttcaaaaacaaaaaatgaagaaagtgatgttacaaatgtgataattgcgttaataaaagcgattgcaacaaataatttaattgctgtaggattcggatttttagtgattgcataagctgataaaattccattaaaagctgacattagaattaaagcgatactgcagaacaaaaaaataccttttgaaatacgtgcttttgctgttaatttaataatgtcaagttcaatttttgcttttattttttctttattcatcttttattttcctggttttttattttctaatttatttttaagtgcgtttaaaattcctaaatatttagaaattgaattaaataattcaagttgtaaattttttgcatttgcatatttcccagattttgtttcaaataaaataagttcaatttttaaaaagtcattaatttcttgattccgatttcaacgtggttttactaaaaaaagtgcaaaaagtccgttaattattgaaattgaaagattaatccacaaaacaaaaattggtcattgatcaacaattttcccattttcgtcaacataggtaaaaaaatttgcaaatggttcaaatacacttaattttggcgatgcaagtttaaaaatacccattaaagttgaaaaaaaagcaaaaaaaatgctaaaaagcgatactgttcaaaacaaaaattggaaaaattttgcctttacaagactttttttatataagaatttggcaaattcatatgaatttgactccaggcgaacattttttacaatcactttttgccaccaaaaacgatactttttaaaatttttagctttgaaacttcttttttttgaaaataaaaatcagaaatttgttgataatctttttcaaattcctctatattatattcattatcgttttggatttgaaaaaaaatataactgagttctcgttgtgcttttttataatccttaaacttcataacctcacggtaaattgcaagaaataaattaataaaaaaagttaagcaaataaaactggctagaacaattgtcaacccgaggtctgcaaaaattgacttatttggagaattaattaatcgataacggtttatttcaacaataattactgtgattgccagcgaaattacaattatgtttgcaaaaaaaataatccattttatagcattaattccataataggcgatttttttacttctttttagcgcttgttctttgttttcaatgaattttttgagccgttcaattgtttcgttttgtgacattttaccttttaatttaacaattttagttaattttttagttcttaatataaataataaaaaaatttactattttttacttaaaatttttccactttttattcaattataacatattctaatttttctttgttaaatatacagtgaattaattaactaggataaaatttagctgttattttttaaaaaaaagttttttatttatgataatatggtataattttaaaattctaacaaattaaaatcttttaggataataagaacaaaatgtctcaaaaaaaatcaaaaaattttctaactgagaggcaatttattttttatgggcttaattacatcgttggatttggctttattgctacaatttcaaatgtaattagtcaaggtgtttgagggattttagtttttattctaacttcgttgattactctagccgtaatttttgcttttgcaagagcaggaaacaaataccaatctgaagttggtggatcatatgcatatgccaaaaaaaccttcaaaaaagagatggtattctttcaaggttggaatcaaataagtcaaattatccttttttcaggaacaacacccttatttttttcaaatctattaacatcttttgatcctgaaagaaaatgaatttatgttgctatttctttagtaatttatattggtcttattttaactagtgcttttggttttcgtctttcaaagtgatttgtatttacaactgcaatttttaaatggctaactttagtaattggttttggtttaattatttacttaattagcgagtcaaaaagttatggtcaaacttttaaaacaattgcgccttttagtgttttgagtctttccgggtcagttttatcttttatttattcttatggcggttttgaatcattagcgacaatttcaaagaatatcgagacaaaaaggttcaaaaagttgataattttaatctttttaatcgtaatttctagttattttattttttatattatatttttaggattaggaccagaatatttagcaaactttggacttgaaggggtttataaagcgctttgaggttcagcaggcacatccctttttacaattgggcttacttttaataggatgtcaggagcattttcttatgtccaaccgcaagcaagatttatttcccctcttgcagaagatggttttttacctgcatttttagccaaaaaaaataaatataatgagtatcaaaatgcaatttatttagtagttgttgttgcaattttttcaagtttagtttttacaattattccggaaattcttaggatagaaaattcttttaatacaattttagcagccggtaatatttcatttttagtccaatatttacttactatttttacagttttgctttgaaaatgacgtaaaagtgagaatattccagtttgggaaatcataatttatattttaggtatgttaaccattttatttacacttattttttctcaactaccttttattagttcgaaagaagtgacttttgaacaatttatccccataattagttatgcttttgcgattttaattgggtatattgttaagttttccgttcaactaactaaaaaaaagaaaaaaatataaaaaagtagttaattttttacttatttaataaatgtttattatagtttttctaattttatgtttttattttaaaaataccagaaaaaagtaaattttttcctatttttaaaataaaatctaaaaaaatgttgtataatttttttagattaaaaataaaatgatatttatttttcctttttatataaatttaaaccaaaaacaggagttataatttatgaaaattatatcaattgggacaaatcatgctggaacttcgtttctaagaacattaaaaactatttatccgcaggctgaacttgttacttatgatagaaatactgatatctcatttttaggctgtggaattgcgctttgagtttctgatgaattcagtgatccatccggacttttttattcaagtcctgagcaattaaaaagtatgggaattagcgttaatttagaacatgatgtaataggaattgatcgtaaaaataaggaagttactgttaaaaacttagttactggtcaaatttttaaggataattatgataaattagtgtttgctggtggaacttggccaattattcctccatttgaaggaattagtcttgaaaatattttggtctccaaaacttttacccatgcaaaaaccattaaagaaaaagcggttgatccatctataaaaaatgtaattattattggtggaggctatattgggattgaattacttgaagcttttcataaatatggcaaaaaaactaccttgattgatatgcaagatcgaattatcccaaactactttgatcatgaatttacccaaaaaatggaggagaaaattcgtgctgaagggataaatcttcaattcgggcaaaaagttatgcggtttatcgctgatgaaacaggtaaaaaagtagcatttgttgaaaccgataaaggaaaatatgccgcagaccttgtgattttagcaatcggcttttctccgaatacaaaaattttagctgatgttgaaaaaactccaaatggtgctatcaaagttgatcaatttcaacgtagtttaagtgatgaagatctttatgtaattggtgattcagcagctatgtttcataatgtaactgaaaaacatgctcatattgccttagcaacaaatgccgtaaaatcaggaatagttgctgcttttcaccttgctggtcgcagtgatattccttttccaggttatgttggaactaatgcaatttccgtcttcggatttaattatgcatcaactggttattctgaaagaggttgttcattaatggggctcgaggaggttgcaactgaatatcttgaggactgagatcgccctgaatttatgcaggaaaaagcaaaagtttgaattaaaattacctaccataaaccaactttaagattacttggggcccaaattggatcatatgggaaacaatttaaccatacagaagtaatttattttctttccctggcaatccaaaaaagactgaaattaacagaaattgctctttcagatttttattttctcccccattttaacaaaccgtttaactttgtagttcaagtaattttaaacgctttagggcttagttataataaaaaattaaaataattttcttaattttttccaattttcattatttaataaaaacggtttcacttttaaagtaaaaccgtttttttactttttataaaattttagtaaaaaaaaaaaaaaaaaaaaaaatgcagcttgaatttttaggaaaatttttttcaattttaaaaaaatactataaaatcaagtgtatttttgttttttaatttaaaaacatcttttcaaattcaggttcaggattaatactaaaagtctttggaattaaatcctggatttgtctaagatcaattggactagatgaatatagactaaaaattaattgatcttcttggacatattcaccggtttcaacctcaagggagattccagcctcatagtcaattttttggtttaattttgttctccccccacctaaaaaagcaacaatttttccaaaaatcaaggcattttctcatttaatataaccattttgaggtgcaaaaatttgctctttataagcgggaattcaaaaatttgaggactgaattaatgtcagatttccaccttgagcacttaccattttcaaaaaaagttcataggcttgaccagattcaattacatcttttactttttcgcgggctttttcaattttaattttttcaagttctgttaaggtttgagcaactaactcgcttgcaaattcactaagttgggactgatttccttgaagaatcgaaagtgattcaataatttcgtttttatttccaatcatttttcctagcggtgcttccatgttagtgattttaacgatagttttttttccaaattttttccctaacattttaattttactagctaattttttggcttttggcagttcagtcataaaagcgccattaccacatttcacatcaataaggataacatcggccccagttgcaatttttttagacataattgaactagcaattaaaggaatcgaggaaactgtcccggtgacatctcgaagagcataaatttttttatcagccggaacaagtgcgtttgattgggcaacaattgcaagtccaattttttgaacttgttctaaaaaattggcctcagttaattgggttttaaacccaggtattgactctaatttatcaattgttccacctgtaaaaccaagtcctcgtcctgacatttttgctactttataaccaagggaagcaaaaataggtccaataattaaagaaattttatcgccaactcctcctgttgagtgtttatcaattttaattccgttaattttcgagagattaattgtatttcctgaggcgataatttcacgggtaaaataaaaaagttcatcatcatcaagaccgttaattaaaatggccattaaaaaagccgaaaattgatagtcagtaattaggccgctttgaaatccgttgatcataaaattaatttcttcagccgaaagtttatgtttttgtgattttttttcaattatttcgaataaactcataatattaaatagcctcaagagcaatttcaatcatttccacaaatttttcctgtcttgtaaccgaatcaagttcagattttgtgattaaattatcggaaatagtaagaattgaagctgctttttttccgagataattagcgattgtaaagagcgcaaaagattccatctcgactgcttttgcctttgatagttcaatagttttttctaaattacgacttgagtaaaaaacatcggttgagtgaattcttgtataaagtggatttagtcctaactttgtagcactatggaataaatttgctactaaacctggattagggtgggctaaatgtactttttttcccgaaataagtgcgggaaaagagcaagaatctgatcaggctgaattagcaattacaagtgaataaacttcaagatctttatcataagaacctgctgaaccaattcgaattattttttcaacatcataaaatttaaataattcataggcataaattccaattgatccagaacccattccggaagcggcaatagttactttttttcctttatattcaccagtaaaaatcaaattatttcgaacttttgagactaatttagcatcttttagaaaatttttagcaataaattctgcccttaacgggtcgccaggcattaaaactatcggtgcaatttcgttttttttagcttcaatatgtgctgtcattttttctccttatgttaattatcaagtgatattataatataaaaagggcatttttgttagtatttctttgcaaaaaatatctaaacttttatttttcaatgatagaacaggtatgaataattctaaaattaatcgcaagcaaactaaaaaaacaaccaaaaactaggccaaaactgtaataagtaataccaaattcaattaaattatatagattaaaaattattaaagagataaaagataaaattatcaaaataaaataaattctattattcttttttagataaaaattgcagatatctttttgaaatttaacatctttaagtaaactattttttcaaaaaattggagcaattttatccaaaaaagtcaaaaaaataaaaattattagcaaaattccgcttaaactattaaggctaacaaaactaataaaatttaagctttggaggtaatgataataaataaggttttcaaagatcgaaatagcaaaactgaaaagagccaaaagccagctaaattttgttcaaaacataaatgaagaactattcttttgtctttttattcaacttgttcgctaaattttaccatctttgcctaaaaaaaccaagcaaaatggaaaaatttaggaaaaagtgcttatttttccttttttttagttttttcgccagtttttcttaatattggtacggcaaatttaaaacttgattccggcttgatcttactcattcgggtttttagcagtttgttgcgcctctccttttgttctttccaaatcctcattgttatttatatttgttttttcgttattatcttcttcctctgatgatattaattgtttatctgcataatccgcaccgaatatcagtttattatatgcatcaggatcatttttaaaatccacaaattcaactttttggggattttcattttgaatttcttcctctatttcttcaatctctacaatctctaaattttgttcttgtattaggtttttttcttcctcgctcatcatttcaagttgttcctgctgcatttttactaaaatattttgtttttcatcaagaggcatttccttttttaggttaactagtttgctatctccgatttttcaaagttcaaattcctctcctgattcaaccttttcaatttttagtttagcaagttgtttttcaataaattcaggctgtttttcttcttttgcttttcttgcagccgcgattctctcctcgttagaggcgattatttgatcaattatttcttgagggctatctgccggataagaaattgcggttccatcagacaaaattgctttgatatattctattttttcagcatttgaattattaaataaagaaactattgcctgataagcggattctgctactaaaatgttgaatttttttgttgcttcctcggtaaaaatttgataaggatttttctgggaatactgaactaaattagcagaagatcttaatttgtcaatggtgtcaatatgattttgtcactgactatcaagtgttgataaaataatataacgttctgattcaaagtaggtttttccaagattttcctttaaaactgattggatttgtttaaaataaatagtttctaattgtttgattaaaaattcattaagttgttcaatgggataattttcaattccaatttgcccaaagttaaaatgagtaattcttgataaattatcattaagaaaatttattaaatttttatagtgaatttcttgatttggtaaaattataaaatcatagcttaaaatgatatcaacagcccgaataatcatcttctggatataatggtcaaaattttcaatctgaagcaaaatatctctttgggcataaattaaatcacgctgttgacgaataacatcatcataactaagcacagttttgcgcatatcgaagttaaagccttcgattttcttttgggctgcaagtaaaaccgcatgaatatattttcctttaattgccccatttgtttgtccataagcgccaaaaatttgatcaaaattggtaaaacgccgaaaaagttggtcctgaagtgagataaaaaatcgcgaaattcccacatcaccttgtcgtccagagcgacctcgtagttggttatcgattcttctagcttcggctttatcggttccaagaatataaaggccgccaagttcagtcacaccaggctctaaaattatatcagttcctcttccagccatatttgtcgcgattgtaatcgcattttttcgtcctgccttggcaataatttcggcttcaagttggttttgttttgcatttaatactgtatgataaagtcctttttggtttagcatctccgaaagcgtttcagagtcaacaacttgtgaggttccaattaaaattggctgccccattttatgaacacgttcaacttcggaaattatagcttgatttttttcgtgactagtggcaaaaatttcatctttttcatccttacgaatcatcggtttgtttgtcggaatcacattcacgcgcatattataaacatcgataaattcttgttcttcggttttggcagtcccggtcatccctgataattttttaaaaaggcgaaaaaaattttgataggtaattgttgctagtgtttttgtctcaggttcaatttcaagcccctcttttgcttgcagggcttgctggagaccttcagaataagatcttccagccataattcgcccagtaaattgatcaactaaggcaattttgccgtcctggacaatatattcaacatcgcgtttcatcaccttattggctctcagcgcgttttgaattcgatgaactatttctgagttttgaatttcatataaattacgaaggccaaaaaaagcatttgccttatcgattcctttatcatttaatttaattcccttagtttcttcatcaatataaaaatcttcagcaattagagtattaacaaattggttcgcggataaatattgggctggaaggttagttttgccaccactgataatcaaaggggttttggcttcatcgatcaaaattgagtctacttcatcgattaggcaaaaatttagtcccctttgaactttttcagctgctgaaaaaaccatattatcccggagataatcaaaacctaattcagaatgaaccgaataagtaatatcggcattatacatcattcttttggtatttgcatccatttcggttttgttaattccgactgtaaggcctaaaaagttatagacttttccattatcttcagcatctcgttcggctaaatattcattaacagttgagacaattaccccttggcctaaaagcgcattaagatagacaggcgggattgaagcaattgtttttccttcaccggttttcatttcagcaactgatcccatatccaaaattagacccccaagaatctggacatcataaggggttttgcctaaaattcgcttggtcgcctcgcgggcaactgcgaaagcatcaacacgaatatccttgagtttttcgccgtttgcaagcctttttttgaaaatattggtctggtttgccaggtcaaaatcggtcattgcaccataaaaactacgtttttggttaatttgtttcaaaagccggtatgcgagccgtaattcggatgaggttttaaaaaagttaaatagatttttcatcgttttaatatggattttttgaataattttaccaaaattattcaaaaaaataagaaaagtttatcaatttaattacctatgtaatataaataagaaaaatttaggattctactaaaatcttaataattttttattttttataaaaaattatatttttaaattaaaaacttattaaaaagagattttaatttaaaaatacctgtttttcatttatttttgtcattttaataacttattttttaatttattacaaactaaaaaataaaaaagatgcgtaaaataaagcatcttttcagtcttaaataagatatggtggctccgacaggaatcgaaccagtgacacacggtgcttcaaaccgttgctctacctactgagctacagagccatggcggtctagacggggatcgaacccgcgatctcctccgtgacagggaggcgtattaaccactttaccactagacctctggttgcggagacaggaatcgaacctatgacctttgggttatgagcccaacgagctacctctgctctactccgctataaaatttataagatatttttgaaaaagtactataaaataaaggataatttggcgggcaatgagggattcgaacccccgcgggctttcacacccctgccagttttcaagactagtcccttcagccacttgggtaattgccctttttggtggatctaactggattcgaaccaatgaccaaccggttatgagccggatgctctaaccgctgagctatagatccagtttaaatttaatttttgcttatttttttaaaaaaattaaaaaaataagatttttggtggctccaaggagattcgaactcatgaccttccgggtatgaaccggatgctctaaccaactgagctatagagccattttggtggagaggaagggagtcgaaccctctacctcctgcgtgcaaaacaggcgctctagccagatgagctacccccccaaaaaatggtgaagaagacaggatttgaacctgcgaccactacgtcccaaacgtagcgctctgccaagctgagctacttctccaagatataattatacactaaatttttaaaaagtcaaatttttttatttttttaaaatatttcttttaaaaaaataaaaaaatggcgatcacgagaggattcgaacctctgaccacaagcttagaaggctcgtgctctatcctactgagctacgtgaccacgcctaaataattataccattttttatttataatttataattatttaatatgaaaataaattgatttccaggtcatatggcaagaagcataaatgacatagaaaataaagcgcgaatagcagatctttttattttaattgtggatgggagatgccctatttctagtctaaatgagaattttttgcagattgcaaaacaaaaaatgacactagtaatagtaacaaaaattgatttagctgataaaaataaattcactaaaataaaaaaattttttacggataaaaaattttttattctctttgtaaatttacgagattattcagctagattaaaaattctatcacatttaaataaaatatttaaaataaaacaagaaaaaaattcaactaaatttttttcgccaagtctaaaatgttttgttgtcggagtgcctaacactggaaaatcaacgctaataaatttaatcacaaaatcacaactaaaggtaggaaaccaaccgggaataacgagaaataatcaatgaattagctatgataaatttctttttcttgacaccccaggtatcctattgccaaaaatgaacgatcaaattttagccgtaaaattagctattattggtttgataaggtgggaaattctaaatattagcgatctttttattgaagcatacaaaataatttctgaacaatatccaaattttattacagatttaaaactaaaaccctcactaattgattcagagattgaagaaaacttgttgattttgtccaaaaataaaaaatttataaataaaaatggtctagatttgtctcgctgtcgaagatgatttttaatgcatattggcaaacaaaaaattacactagattaatttttttaagaaaattaaagttcattaaaaaaattttttagaatagttaatttttaaaaagatctaaattactatattaatttagatgcaaaaatgcggtatttttcttgttttttgccccgcagaaacaagtttatattttagattttaactttatattttttagattttttgcttttagaagtctagaaaagtctataaaaaggttgcttaaaatgcaaatgagtttttaccacaaactgcaaataaaaattatttgcctgatttttttactaatttaaatttatatgtagtttttttcttttggatcttcttcatatttatctaaataattgttttttaaatcttcaattagttcaagtcggctaacttttttatcaaaaacgatatttttatccttaggaaaagccaggatttggaaggccactttatcaaaactggattcaggatttgtattaaaatttagtgttaaatccgttttaaaaattgttgtcaaaaaaatattattattattattattattttctgtttttctaagaaccaatttttctcattcaaccctttttgaaaaattagtagggggggatataggctggagaacccctcctcaaaatggttcataaccaattcgttcccaagtttcgtaaataaaaatattattattttttagaaattcatcaagtttttcgctgtttagaaatttttcttcaaaatcagaaattaaatcattttggtcaagttttaatttaggatctaattttaaaattcggtcaataattgttgtcttaaattcgtcaatatttttaataattgtatgtttttttggtaaaaaactgttagatcaaggattaattttatttgtaattaaatcaagaatttttggctttaaagttttaatattattaatttcttggctaaaattgataatattaaacataaaagaggggtaagaagtactaatcttgttttttgataaattgtacttttttgcgagtttattataaatttttctagcttctccttcaattaatattttctttcttttatagtctatatttttatcattatggccagtgtaaattttttcttcaatgttcctaaaggtgattgttttatttttagggtagactataacattaaaaaaaggtgaatcatcaaaaactacagcgggttcaattaattttgcatctataatataatctggtgtaaatcttgtggctataatgtttgaaaaaccattttcttcaaaataatagtgggtaacacgagttggttttcaatatctaccacgctcgcctattataatattgtttttttctaagactttttcaagaagttctccttttagaaacttgtcttcaaattctgacttgagttcagaactattaactttagcaaaattaggattattttttataatttcttcagttctatcaacaatatttttttgaaattgctctaaattttcaattgttattctactttgttcaccaaggaataaaaatttgtcccgttgtttttcgggttgattataaaacagatttaaggctgaaaaagtaccattttttgcattaaattcttcataatgcttcgctagtaaatttaaaaaataataagaattataattttctggattgttaattccctcatctttgttaaaaatttgcttaacaataaaaggaattaaatttctgcaggaagttaaaaaaaatgccggaattaaaagggttattcccaaaaatttactaagaattagtttatttttcattattaaccaaataagaaagtgctaatttatcttcaacagaattatcaaaagttacagatttaaattttttgatataaagccgatagtagcctgattcttttgctctaaaatcaattaattcatcattgcttttaatacttgttgaccaagaaacatcaattcaattattgtttgaatcaagtttttgcaaatacaaatcataatctgaaacccaagtgtcattttgattttttttagtagcttctaagtttaaacgttcagaattaatatgtgtttttgaccatttgtcaaagtcatttttatatttgtctatcttagctttagcatctaaaatagctgcagcgcctgcaattgggaaaacaatcggagcaaagggtgttaaaaatcaccatcaacttatgtagttgctcttgtcaggcgcagcaactttattttttagaagaccagcattaaacattcaagataaagaagctttaattctatcgtttgaatttactcagaatggtttgctagtaaaaattatttcattttctgattttttttggtctttaataaagtaggtattttcactagcttttaacatatttttaaaatcaggagtgcctgagccatatttttcaaaataaccgcttttctttttagttaaatcactatgatctggggaaattgccgaagcagataaaattgcttttaatgctattagtctattatcatcattatctaaatttggtttttctcttagcagtgttgatattaagccagtgacaacaggggctgcaaaactagttccgctaacaaaatcatccttagaacgattagtaacaggattataaatccgcccgggagcgacgactaaaggtttggccagttcataatattgttggccagttttataatttgaatagtcagcaattttgtttttggcaatttttcaaggttcagaattatcatcaagtgccccaacaactatagaatttaaagacaaacttcacgcatctattcaagggtggtcctcatattcctcatcagaatattctcttgcaccgttacccgctgcaaaaacgttaataacaccatattttcttgctaaaaaatcaagaaaaaaggagtcttcatcataatcgtaaaactctttttttccacccccataactatgatttattactttaacattattggttttaaccatccattcaattgctttttgtcattgactgttaataccaaatatagacaaatagggagttgacttggtatcaatgcccagtttaccgcctaatattaatgatactaaagttgaatgatatggttctttttgaccttccttttgttcatttcacttattagtagatcccaagtcgttaatatgaaaattattagcattaaaataactcataaaattatagttaaattcatcagtaacttcaattgcgccaacttttgtttgtggtgatttgtaagttaattcatcctttttagtctgttcttcaaaattaacaatcttaatattttttaacaatgattctttgaatttgtcaattggagttttaggtaaataatggtagtaattatctagaaattgatcattataacgataccaacttaaaggctttatttttttatctccttcatttttatatacgatgtaacgactaatgaacgagttttctattgaattctttacaaaaaactctctatcattctcggtatcaaaataaaaccatacaattggtaatattttactgctcttaacttctttgaattttaatcttgatttttctatttttttaataaattcaagattaaagttacttatttctttagactcagtactcaagaaattagggtttaacaatagttttaattcgaattgattatcaaaatcatcaatttttgccgagttactgaactttttggcaaaaggttctcttatatcgattttattactaaaatttgaagcatatcaatattttttagtattaaaatttataagaaaagagtgatatattaaaaaaattgatggtcaaaacaccaataataaaattatttttttaaattttgctaatttcatttttcgcacccaattaaaattatttataaaaattataacatattttgtctttttaattttaagttagtatattaatttcagacacattaaaaaaaaggtgtctcaaaatgaaacaatacaaatttaaatatatcaaaattgctgaaactaaatggttaaaaattgcaattttgcattttccagaagaatttagagaaatttacaaaaacaaatctaaaagtaaaaatgcgcataaagaatgaattttgcatatatatggtaataatttaataagaaattggaaaaaagttttataataatggtatgaaaagtctaataagtgctcgtgggaaaaacaaatctccatgcagaccaaaaaagaaatatacaattaacgatctttctgaaattgatcgtggaatttatcaagaaataatggagaatgttcttagaagatacggaattgaccccgcaattgttcttgaggagcttaaaaaacgaaaacaagaactagaacaacaacaaaagcaagaacaagaaaaagataaagataaagaaaaaatcgaaaattaagttagtatataaactaattgtctgaattttttctactaacttaaaaatatgttataatttttcttaattatttttgtgtagagagaaggtagtaacattttttaccttaatccttcaagtttttatttatctctttttgtaaatttattagtttttcttctaataattcttgctgttccgattttactagttttattagttgcttttgtcaaaccgcggattaaacaaacatcaaatatttatctttattctttaagtagtggacttttgttgatggttgcaactgttggacttattcaagaaggttttcatggggctgaagcattcagtcataaatttgaaaatttagaaaatttatataaaattttaataattggcgggggagcactttttggactagttagtgtttttattgctcgttgattttttattagaatttttaaaactgaactacattcagatcataaaaagcatgaccatagtgatcatattgtaaatttttctgatgttgatagtccaaaaagtgcttgacttgcgatacttcttttactttcacaccgaacaattgatggctttattttaggttcagtaatcgcaagagtaactgctggggacccaataaattgatatttaattggaacttttatagctcatatgttaattgaagttttaataattcactaccgtcaagttcagtatggccaaagtattaaaaaatcagtaatttataacttaataacaaccctgattttagtgccgattattacagttggcgcctttttgaaccgtttttttattaaaacaggctgactaataccattttttaatgtttctggcggggcaattttaagttttgttgtcataattgagttagttccagaatttatccatttaagaaataacccttcttttcagtgacatttttctctttttttgtttgctttaggaattattttagccttaattattttaattttacatgaacattaagcgcgtagatccacaaaaatactataaatttatagtatttttgtcgaagagtaattagataaattcctgaaattgatgtaaaatttaatataaaaatttctaatttttgttaatttttaaaaaaatttcataaaagttagaaataagcctaaataattatttaaatttaaattattctttgttttaaagtattttttggtaacaaaaaattttttgattaattttaaaaaatatgttataattattttcgagctacaaaatgtatattaagctttggtttagttcaaaccgctcagatgaacatctttgactttgcagttgtagttaaagcaaaaaactgcaccaccaaatttatttggtggtttttatttaaaaacaattattttatatttaaaattgtttttaaataagcgccagtatatgattcactaacttttgctacagcttctggtgttccttttgcaactatttggcccccgttatccccgccgtttgggcctaaatcaataatatagtcagcaactttaattacctctaaattatgctcgattacaattatgctatcaccgttatcgactattcgatttagcactttaattaaattagcaacatcataattatggagtccagttgttggctcgtcaagtacaaaaagtgattttcctttaggttttttttgtaaaaaagtggctaatttaattcgttgagcttctcctcctgataaagttattgctgattggccaagttttatataaccaagaccaacatcagctagggtttgtaattttgcgattattttaggccaattatggaaaaattcaagtgcttctgaaactgttaaatcaagaatatccgcgattgtttttccataaaaacgaatttgtaggacatccggcttgtatctttttccttggcagtgatcacataaaacataaatatcaggcataaaatacatttcaattttaatttgcccgtctccttggcatttatcacaccgcccagtttgcagattaaaggaaaattttgactttgaaaaaccaagcgctcttgcctgctcagtattggcaaaaacctcacggatatcatcaaaaacagaggtataagttgcgggatttgatctaggggttcgtccgattggactttgattgattgcaatcaacttatcaatattaaaaagccctttaatttcctcacattttccaatgcgaatattagttgttccaagatttttggcaatcgcatttacgataatttgattaactaatgtcgactttccagatccagaaacaccagtgacaacaacaaatttgcctagaggaatgttgacattaattttttttaaattattttcagcagctttttcaataattataaatttgccattgccagcccgtcgtttttttggtactggaatttccaattttccagttaaaaattggccggtaagtgattttggttcattttcaatatccttaattgatcctgcagcaaccaaaaaaccaccgttttcaccagcttttggcccgatatcaacaatataatcagcagctaaaattgtctcaaaatcatgctcgactacaattaaactattaccaatttcaaccatttttttcagtgtcgcaattaatttgtcattatctttttgatgtaggccaattgaaggttcatcaagaacataaagaattccggttagttgagatccaacctggcttgcaagcctaattcgttgggattcgcctcctgataaggttgccgttgatctatttaaagttaaatattcaagaccaacatttgctaaaaatgacagtcgtgatttaatttcatcgagaattaaagtagaaatttttccgtcaaattcagttaattttaaatttctaaaaaaagttattaaatctttaattgaaagttgggataattgaaagatattatacttttcaatgaaaacggcaagcgcatacttgttaagccgggctcctttgcaactactacaaggaaattctgacatcattttcttaaatcaaagtcgtaaatcttcgcttgatgtctcccaaaattttctctgaattttattaagaattccttcaattggtcgaaaatagtcatatcttttcccgctttcagaaattagtcagtaatttagagattcttttgatccatatttgattatttcaagctcatttttcttcatttttactatttctagatcagccgagatttcaaaataatcaagtaaaattttaaattcttgtcattcaagtgattttgtatttattgattttccaaaatatttaatcgctccctgatttatagttaaatttttatccggaacaataaggtcaaaatcagcctccaaatttgtacccaaacctttacaaacctggcacattccataaggtgaattaaaagaaaaaagccgattttcaagatttggcatctcaaaatcaccaaaaggacaggcttgtaattttgaaaatctgatagtttcagattcattaaattcacaaagggcaattccttttccaagatcaaaggcaagttctaatgctgactgaagtcgatttttgtcctctttttcaagcaaaaatcgatcaatcactacccaaattgtgtgcttctgttttgggtcgagtttaatatcgtcagctaaataataaaaagatttattaatttttatgcgcaaaaacccttgatttttaagatttttaattaaattttggtgactccctttttcaccttcgataattggcgccataattataagttttgttttttcaggatatgctaaaattgtatccaaaattgtgacaattttttgagctataatttcaactttgtggtttgggcagaatgctttcccaatttttgcatataaaagccgaaaatagtcataaatttccgtaattgtaccaactgttgaacgcggattgttatgacttgttttctgttcgactgaaattgtgggtaaaagcccataaattgcatcaacttttggcttttttgtcccacctaaaaattgccgagcatacgaacttaaagaatcaatatagcggcgctttccctcctcataaatagtgttaaaagcgagcgaagatttaccagaacctgaaagtcccgtaaaaactattagtttattttttggaagaacaagattaatattttttaaattgttttcgcgtgcgcctttaatgtagataaaattgtgagtgtctttatttttaagcatttttcggtattttattacttttttgtgaggtctttttattattttctttattaattttagtatttatagcagtaataaaattagattttttaaatttttttgggctttttggtatattcagttcttgttttttcgtttgaaaaagggtattttgcttcttattttttaaaggataaagtttttttctggctaataaggcttgtggatctcttgaatttttaacattttctttattattataaggtaaattttttgagtttataagacttttttttatcttttttttagcatcattttcatagcttttttttaaattttcttttttaaagaatactaagttttcggtttcttgaggatttttatttttaaatttatttgggtttttctgattagaatttggtgatttttctattagaatatcactttgattatcattttttgtttttcttaaagtggaatttatttttctagtcacttttttaattgattcatttattttattttcttgatctttttctgccttagaagatttgacattcacatttttttgcctaatttgtaaattttgtacttttttatttaaatctgattttttagctattttattataattttgttcagtttttggatggttttccatttttttgccttttttagttggaatttctttatttttttcactttctttggtaagattagttttaattttcttaaccacaaatttttccgtggttttttcctggtaattttttagaaaatcttctttttgatcaacataaagaatttgtgttaaaattactggttttcaacgttttgttctatggaaatacgaatttagccgattttttattaattgtttaatttgcggtggtgatcattttggctgtttttcaataaaaaacttaattgatgcaaaacaaagtcggcgaatttcagcaataatttgtgttccatttttagttgaaaaagctccttttgtaataaccgaaattcgcccatttattgaatttttttgtctatcaaatggaactaagacaaaaacaaaaccattttcccgcatttcttgtcgctcattaataatccgggagttatcccgagagatagtctcaccgtcaatataaaccggatcacaaggaattttttcatttgttttataaatttcttgattgtacattttaaaaacttgaccgttttcagggataattacattttttggatcaactccggattcaattgcggtccgcgagtgggcaaggcacattcgatattcaccatgataagggaaaaagtactttggttttgttagttgaaaaattttttcatgttcggctttataagcatgaccggaggtatgaagataaccatcaggtccattttccttaataattgcgcttaatttatataatctattgatcaaatgttcaattttaattttatttccaggaattggcgaagaggaaaaaataattagatcccgaggttcgatgctgatttttggatgttttctgtttgacattcgatccaaagctgcaagttgttcgccctgggatcctgttgttaaaattaacatctgattttcctcaacaccttctaaatttttaccaagaaaaacattatcatcaacatttatatatcctgaacgacgaccaatattaattccgtttaccatcgagcgcccgaaaacaaggatttttttttctaattttatcccaatttcaattagtgctttaattcttgttaaatttgaagcaaaagcggtgatgataatttttcttgtagcagatcgcatatgcatttcaatatcacccagaatatcccgttcagaaggtgaatggtttggcctcattgcatttgttgaatcagaaaaaagcactgttaatttttggttcccaatttcttttagtctttcaaaatcggtataatttccaattggggtataatcaaaacgaaagtcgcctgtgcacataatcgaaccatgtctagaggttattctaattccaaaagcatccgggatagaatgctgggcggttcagaaatcgactgtaaaactttcaaaacgatgagtatcgttcttgttgatttcgataaattcaatctttggcctaattttttggtcctcaaattttgcttttaaatattgaatagcgatttttggggcaaaaatctttttaatatccacttcttgaactaaaaaaattattccgccaatatgatcttcatgaccatgagttacaaaaagaccacgtattttagcttgtttttcttgcagatactgataatttggcaccattcctctaatgccggtatgaaaaaggttggcaaatttgattccagcatcaataattacaatatcataatcatcctcgataactaaagttgacttaccgatttcctgcataccaccaaggccgaaaaaacgtgttggattcaccattaaggacataattttcctaacaatattatctttttttaatttttttataataatttataaatttataaataaacatcagcaataataactatcatttcaaaaaacgatagtttaaagttttttaacttcataatcataaacttaaggtaaaactttaagattagaacatattttagcagatttttttaaagaaagtagcaaaaattagtttttacagacgcgaattagtcctggattatgtaaatctagcttaaattgaccttcataagaccgcaaattatcaagaatttgctcataaagatggccaaaaccaataccagaaattaaattaatacatcttatttttgaattttttaattcaaaaataagattttcaacaacagccgctgttttttggcgatcaaatccatgaaaatcaaaagttttttcattataaggataaaaatccttaatattagagttggatttgattgttaatttttggatttcatctcaatagccaaagtgaaattttttctctttctttccaaatttcattcttacttggatttcatattttataatattttttttgttttaaatcaaaaattcaattaaataattataccataaaatttaaaaaatttattaaattccatttttatttttatattttaaaaataaaataaaaaaaattggtaaaattacaacaaatggaatcaattaaaaacaaagaaataaaggttaaattagtcgatagcgggaccttaacctacaaacttttagaagcaggcaatcctggtgactgattttcgctagtaagtgagattcaaaattatattgaacaaaaaactaaggaaaaaataaagcagaaattagaatcatttaaatcacaaatccgaaatgatatttttacaaacgatgatgaaataaagcaaatgaaggaaacaattcgcaaacttagtgatgaaaatagtagcttaaaaagtgaaaaccaaaaagaaacagcaaatttaaatactacttttactcaaacaattagtaaaaaagatatcgaaataaccaatttaagaaatgaaattggcaaatttcttgatgaaaaagataaaatgcgaagtgacattcttgcaaatgatgatgagataaaggcgatgaggagtgaaatttctcaactaaaagaagcaaatgccaacctacaaaatgtcaagttagaagaaatttcaaatttaaaactagaacataaggacgaaattaatgaaaaagaccgtaaaattagttatttagagaataaatttaacgacttggaagaagaaaaaaataattcaattcaaaatgctgtaagtcaaaaaacacgagaaataaaggaaaaaattgaaaaagagctagaaattaaatgggaagaaaaaataaaacaggaaaaatcagatttaagagaaaattttaaggagcaaattaataaacaagaagaaaaaattcaagatttagaagaagaattaaataaatataaagaaaaaaatataaattcaaaagaaattggtgaaaatttagaaaactgaattttagaacgttataaaagtgttttcccacttgaccaagaaaatgatgaaacgattagttttagtctaaaaaaagatacagaaaatcttcgtgatgaaggtgaaaaaaaagcaactaaagcagattttatttttaccatttttgacaaggaaaatgggattaacgagactgtaattcttgaggcaaaatctgagtcaaaacaaaaaccagggaagcagaaaaataaggattttttcaaaaagcttgaaaatgataggataaaaaagcgagcccgttatgcaattttagtaacagaacttgaaccagatcagtacatcacgattgaaattgcgcctaaattcccaaagatttttatttgccgcccccatttttatctagcacttttaatgattctaaagtcaatgataatcaaagaaaaaaaattaactaaacacgttgaaaatcttgaagaaaaagaaaaaataattaaagattttgaggattgaaaaaataacaaagtggcaaaaacagccgaaaaaataagaaaaaaatctgaaaaagcaatggaatctagtcaaaaaataatcgatgaagctacagaaatccaaaattctttaaatgaaatctcaaatactttaattagaaaattagaaaatacaatcaataattttaaaattacaaaactcgctagaaaagttgaaaaaattaaagaaaaagagattcattcttctaattttgtttaatttttatcgtaaaaatacaattttaatattgattttttattctttcaagattttttgcatatttttcaaggtatgcttgtgttacttgatcaatatttcagtttagtatttcgataaaacctaggaaaaattcaaataattctattaaaattttttgatttttttctagtaaaaattgagaagctaagataaaaacccgtttaaattgattattaatatctttattttgaacaaattttgtttcaaaaatttgttttgttttaaaatgaatacaagctgaaactaaaaagtgaattgcatcaacaaattcttcaatagttttttcataatttgattttttattaacttttcaatatttaaaactttcaatttcgttggcaaattcggcaatttctacaattgcagcgattatgactttgtcctctcattttgaatcaattccggattctaaatcattatgagaactatattcagcaaaaagattgtctagaattttttgtttttcaaaaatgagttttaaatctaaagtcataaggaaaaagttttgaaataatctataataaatataaattatagcatattttttattttttgcaagtttttttgtcaattaaacttggaaaacttgcaaaatcttgagttttttatttagttcaagatttttaatatttttttaaaattttaaaaaaatataatttattagaaaaactaaaaatctcgctaatttacaaaaatccttaattttatagtataattaagataacttgggggtttagtataatggcagtaccatggactccaaacccatcagtgaaggttcgaatcctttaacccccgccagttttttatctttgaggattttatttctcgattttttttttgatttaaaaagtaaaattatttcctaattttaatttttttactttttaaatcaaataaatatttaattaaaaagcaaaaaaattttaggtaaggtaaataatgcagacaaaatttaaaaataaatcatataatttagtatcttcattaattcagccagggcaaaaactagaattttctgtaagtgatacaaattttgatgtagttgaatttaattcctttggcaaaacaacattaatttcggttttcccatcaattaataccaaaatttgtgattttcaaaccgtttcaattcgtgacttatcagtaaaatatccacaatttcggtttatttcagtttccttggaccttccttctgcgattgcccaatgaaaagatgctaatttagcggataatttagaaatttattcagattatcgtctccgcagttttggtcttgcaactgggtttttaatcgaggatgtatttttattaaatcgcgggtatattattgttgattctggtggtagagttttagccgttgagtctaattcagatgtccatgatcaaattgattttgttaaattagaagaaaatctaaaaaaattttcctaatttttttaagtaaaaaaataggaaattctaaattaaaaattatttacttttaaaaaagcactataaattacgtgcttttttattttttagtaatttatattttacttatttgaatgcaagatttaactctaaattttgaagtttgtttcataaaaaatttcaaaatatatcgttaaaatttgattagtccttttattaattagattctccaatcgatcaaaattgtatttatattattctaaatttagattattttcatctacttcataataaatctgctcacaaatattttcccgacaaagtggctctaatttactataaatttcttcggttaaatttgtttttgtaatatttgcccaaactcacttacatccatcattactttttttactatttgtatccttatttaataatattaaattaccaattttacaattattttattaaaaccaaaaaaaattgataattatttatctaaatgcttaattaaaaaataaaaaatggtataattattcaataaaaaagttagtgctaaaataaaaaatgacagataatacaaaaattccaccggatttaatttcagaacgcccttttaaacaaggtgaggctttttggttaattcaagattgggttccaatttatgctcttactatggttttaggtatggtcgcttcaattattacaatttattttttctgaagacgggaaggttataaatttgattatttagccattttaatttttattacagttccagtttcaatcatcggggctcgttttggatttattctcgagagattattttatggggattttaattccttaaaaaattggtataatatcagaagtggtggcctttcaattcaatggggtgttttttttccaacatttgcaaatttaatctatatttatcgtaaaagaagcattcttgactgacgtaagtgtttttccattattttaccagcagttttagttgggcaatttatcggaagatgaggaaattttactaatcatgaagtttatggtcatcttgatccagaaggtaaaactgttaattgattaggcagttttatctataaaaatatgtttattagtgatgagatcgctcctgatggacaactccgggtacccttatttttctacgaatctctagcttcgctttttggatatctagttcttgtttgaatttttaaccttttttcttgattaaaaccaggttcaacgggcgctttatacattatttattatgggattgtgcgatcttcaatggaatttttacgtcaagaatcttatttatattattttataatcgcaattttgatggttttttttggtttgattctctttattcgttttcaatttttgacaaattattatttaaaaattgaaaacaaaaagttaaaacttgctttttttgagcgctacaccaaagaaaaacaaaaatatgtaaatattccttgagtttattgaaaccgaaatcctttgaatttagatagacacccaagaatctaaaaagttagtagaaaacttataatttatactataaatagtaaaaaatcaaagtaaatttgaaaaattttctactatagtaattttttccgatttttagaataaaaatattataatttgtatataatttattataatatttttatgaaaggtgctttgctatggaaaattatgatgtaataattattggtgcaggtcctgcgggtctgacaaccgccctttatgcctctcgtggcaatttaaaagtgttaattctggaaaaaggtgccccaggtggaaaattagtctcccagtcaaaaatagaaaattgaccaggggatgagataattgatggtgcaacattagcgcttagaatgtataaacatcctttaaaattcggcgcaaaacaccgcttttgcgatgtcgattttatcgaaactgaaaatgaatttgaccataaagtttattgtaaagacggaaaaatttttcaaggccgagcagttgtagttgcttcagggatggtcgaaagaaaaccgcttgatataaaatattaccttgaatatgagggaaggggtgtttcatattgtgttgtctgcgatggtcctttttatgcaaatcaacctgcaattgtaataggtggtgggaattctgctgttgaagaaggtagttttttggcttcaattgcttcaaaagtttatattttggttcgtgatagccaatttaatgctgagccaatgttgatcgaagatctcaaaaaaaataaaaatgtcgaaatttggtttaatgcaaaagttttagaacttaggggaaaagatcagttagaatctgctctaattgatcataacggtgagaaaaaagtacttgaaattaagtcactttttccttatattgggtttttaccagctacaaaatttttagaaaaaaaccataggcaagcattaaatcaaattaattttattgatgttgattcttatggtcagacaaaaatacccggaatttatgctgtcggcgatgtagttagcaaagaaattcgccaaattgtaacggcagcaagtgatggtgctatagttgggaaaattttaactaaccgaattaaatagaaattaaaaaggggcaataaggttgtgaaaattgttaagaaaataaaaaaaacaaaatatttaacaagaaagtcaaaaattttgttaggcctaggactaagttcatctattctgggaattcttggtatttcagttgcagtatcttatggtcttgcagtaatcaaaaaaaattcttataatacaacaattgccgatctaaatcggctagcccaaaaaattaatggacttagttttaatgcccaaaaaatttctcctttttcaacttatgcaagtctaaaaaaagagtggaaaaacttagaaagtagtgaaaaaagcggcgaattttttgatttttatactcttaattacaaaagattacaaccttataaacttcccaatggcatttgagcagagtttctaaaaattgaacctgatgatgcaaatcaacaatttaatgtggaatttgtgttaaaatcctttaacggatcaagagttataaaatctgatatcaaaagtgaaaaagtagccataagtccaaattctaccttttttttagagaatttttatcaagctttagaaattgatctgaaaaatattagcccttattctaatggtgataaaggtaaaaaaaaccctaaaaattgactagcaagtgattttttaactgaaataaacagccatgaaactgctcaagatgcaattaaaagaattcgtgatttttttaattttgactttgattcggtacttaaaaacaaaaattttgctattaaatataaagataatttaatttttccttataaaatcgaaattcttaaaaatgatgatgacagttggataaaaccatctcaattaaatcctgattttcttgaaatacaaggtagagttagttttactgatcaagcaaaaaaattatttccgaaaagttttaacacaaatattactaaaaattttagctttttactttttgatttagcattaaataaatctgcatttgctgacccgaaagtttttattagaattccgaaattagttgagccaaaaattgatgaattttcaagtgaaaatccgcaagaaaaaattgatttgtcgcaaaagtcaattttttgaatttataattttcttaaatataaggaagataatatatctttaaaaactccagaagaagccaaaaatgcactaaattctttattaaataatgatttagagcttgattttagccaaaataacaatttagaaccaaatattaaagaaaaatttgaatatcaacttttagttgataaaatcaacttcaatagcgatcaaaattcatcgtttattaacatcccttttgaaatttcttatccgcttgatagcgaaaagaaaaacaaattaaaaacagaaacacaagttttactaagaaaatttaaaaattcatcttcatttgatgctacagtttttgatccaaagaatttttctagtcttccgatagtcaatttaaaattcattagtgaaaaaaatcgcgataaagacgatatttttgaagcatttgaaacagtttcaaaattcgaattggaaagattattaaacttaaaccaacagcaacaaatttaccaaatcttaacagatccgacaaaatttaatctaacttttccggaaaaagagattcttgatgcttggatttcaagttataatttcccatcagttcaagaatttagcagaagaaccttagtggccaaaaaacttgaagatggtagtcaaagccgtcctttttttgaaaatagtcgtgaatttattgcttttacaaaaaagattttatcccttgaaaaggctgaggcaaaaaaatatattgagccattttttgaggcgcttaagactgagatttccgaaaaagagtcaaaaaaactagaaaaaaaagcaacaaatttaaaccaaaagacagcgaaaaatagttctacaacggcaatttcttctgaaaaaaatgaaaaaccagaaaaatcaatgtctgaaacacagcccgagttagtaaaggttcagcaaaatcagccaaaaaccgaagaagaaccaaagcaagaaactgataaacaagaaaaatacaacgaccaaaaaaatccagaacaagctaaagatagcaaggaaaaggaaaaaaacgggaattcgtctttaaaaagtccgaatttacctgcggaaaaatcctcagattcccaggatgaaggtccaaaaactgatagattacagcaagaaaatgaacaagccgcttttaatgataaaatagtttctattctgcaaaatcagtatgaaatttcattaattaaaaatctaactaatcaaattgaggcattaaaaaatagtccagaaagacaaaaagtcacattggatgcggctagttttactgatttatttattgaaacttataaaagcaatgatttagtttcgcaatttgacagttttgccgctggtcttaattataaaattgtttttgtagcaaaccaagatgatgagataattgatcaagttcaactaccagaaccaggaaaatctaaaaaagcagaaaaaaccccggattttaaagaagaatctgagaagaaagaacttgaaaataaagaaaattctcctgccgttggacaaaaaagtgatcaaaaaattagcctaagtttttttcaagaagaaaaaaataataatcaaaatcagggccaagaagaatctgacaaaaaacagcagactccaaaaacagctcaagaaaacagtcaaaatttagttcaacaaccaaaaccagaacaagaaactgagatttttaaacttggttattattacatttttactgcgcctaatagtgaaaaaattgttttccgcacaccaattaagtcgttaaaattaaaggtttttttagctgaaaaaggtggaattacacttgaaaaactatcttataatatgctaaatttcccccagtccttactgaaattagagcttgctgatagtaattttacctctgctgaagctctgaaaaaacaacctgaagacattctaaaagctgaatttagttctcaagataaggattttaaagcaacaatgaatagtttcaaaaagctttttggtaataaaacatttatgaaaatttatcctttacttagcggaaatggacttatttacaaagcaaatagtgtttttaaggacaaatttgggaatttaaaaattagatttgcagttaaagacttagatgcaagtgagaaaaaacagattgtttttccaaatattttggaaccagaactagaaaaaaaagaacaggatgttagtccaaaagcaacagaagctgaaagtaaacaagaaaaacaagaaaaatctcaattagcttcagattctagtcaaacttcaataacatctagccaaaaccaagaaaataatcaaaaaaatcagcttgaaattttcaaacccgcagaaaaagaagcaaaatatccacttgtctttacagtaattaaaccaaatcgacaatttaggagaaactagttagatctatgaaagaaacaaaaattaaaactgttgaaaaagtttcaaataaaagagcgctgatgattatggcgacatgaccagttgttgctggagctatttttggtttttcttatctaacttatgcagtaagcgagtcaaaatattttaaaaaggttgatacgcgaaaattagaaacaacagatttaagtcaaatgggaatcgacctaactaataaaaagtttggcgaaattatcgacaaacttgaaattgacaaagattttgtcaagtattcggctaatcaaattcttgaattatctcgtaatttacagtctaattttcatttagttaacctttttaaccttgcagattttagtacaaaatacccatttttaaaacttaatatcaacccgattgataactctgatgttgatgataaaaatttggttacaaaagttgtaaataacaatttagttaacgttgttttttccgctcatgatcaattaagcaataaagtttattcaaaagttcattcaattcgtggttttagtggtaaaggtgagattccttttgtgaattttagtgttgatcagcaaaaatccgcttttgttttaaagcctgttgagattagaaaaaaatgaaacgcactttctttgattgatagtttaaataatgactataaaaaaactcaggatgccaaaaaaacccttgaaaaatacggatcttttttattactagattcaaataatacaattataaatttcccagaaaaaactcactttgattttaaaaaggatgaattaggtgatatagtttttaaaaatctagaagatccaaatggaaatttatgaatatcatttgatatttttgatgaaaataacaaaagaattcgttcttttgatctcaaagttacaaatttacttaattatcgtgaggtcacaaattatcttaacaatttattaaaaaaagaagatgatttaattgagctgaaaaacgaaaaaattgaggaaattgttgccaaaaatgtttctttatcaacttttttcattagtgcaaaaggggttgatcaattttttgatatctcaaaattagaagcactttttactaattcattaccaaattttgctattaaattattcgcgaccaacacacaaatggatcgcttaagcgaagtcgaactgcttgttcaaattgattttcaagcaagaaaaggtttaattgctgaccaagatcaagcccaaaatagtattgagtctgagcaacttggtcctaaaaatttacaaaataagcaggaaaatccaaaagatattactgtttcgaaccaaggacaaaataaatctgaaaatcttagtgctaaaaaaatcgaacctgttttattccagcaacaaaacaaagctagaagcactcaagcgaaaggcccaattgataaagacgctgaaaaactcaaaactgagataaattaccgtaatttcagctttgtttatatattaaaaccttttaaagatttagcacaacgctatcttaacaatgtaattaaaaataataattattatatcataaaaaataattttaattattttagtggtagtgaaattattaataatttaaaaaaaattaatgctagtttttattcttatgaggagaataaaaacacaaataaaggctatgaaattgttaatttagcaagcagcccaacttatgatagtctggccagtcagaaggcaattgtgtcctgatttaaagacttttttaaggatgcccttgaatttccagttgagaaaaatactgataaaactcttaaacctgaagaaattttagcagaaattttcgctaaaatgaataatataattaattccaaacaaattttttcttatggagttaaatataatttattctttgataatattagccgagaattaaaaataacaattagtattcaagatcgaactaataaaattttaggccaaaaagatataaaaattgccggacttgccccatcaaatccgccgctttttgttgcaaaacaaaattctgctagcttttattttgatggagggggtggatttgaaacttttgatcaaaatagtttaaatccaaagataattaaaagttttaaatcaattacaaatccgcaagtttctttaattccagataaaaaaaatactggtgatccaaatccgaacgcggtaaaaatagttaagaatttaggggctttatatccgagtttaaatgatgttgggcttaaatttgtttataaggatcctgcaaatccggagggttctgactgaaaagacgtagaatttgatccgcaaaaaccatttttttatggtttttcaattcaaaataatttagatgtaaataaatataaaattgttttgaattttacaacccaaaaaaatcaagcacaaaacataaataattcagaaagtaatctaatttgggtcaaaaaattatcaaaaaaaagcgagattaacttacaaaatcagcaaaattattccgaaattcccgataatactccagtttggctagtaggcatttccaaaaaaagcgaaattgagacagcaactacaactgaaaattccgttaattccaaaaaaattatcggaattttacctgtttcaaaaggtgactttactaattttgtgctttcttataatggatttaatcaagattcaaatcaaaataacgcctccacaaataaaaagattcttataaaagtcgtaaatttagaacaaaaagatcaaccgggcatcgaattagaagaaaacttttggcaaaaaaacccccaaaattctgatacttctagtcaaaacgagaaattatctttaattcttggggattccgaaaataacaaaaaccacgtaaataccgaggttttgtttaaatttttcacacaatttgattatcagtttgaggataaacaaacttttagaacagctttggaaaattctttaaaataaaagattaattttcgctttcattaagatgcaatttatcatttttaaaagataaattgtattttttatcttttaaaatttcttcggccactatttttttggcaacaaaattttcaatttctttcttaataaagcgcttaattggcctggcaccaaaatttttatcatatccaaactctaaaattcaatttttgactgatttttcaaattcaatctcaaaattattttcctttagacgattttgcaaatcctttagttcaagttcaataatttcaaaaattatatcataatttaaaggattaaatacgataatttcatcaattcggttgagaaattctggctttaaatatcttaaaagttccttttttgcctcaatttcattcatctttttaccctcaagaattttattagcaccgatatttgaggtcataattataattgtattgcgaaaatttactttttgtgacttactatcaacaatttcaccattatcaagaatttgtaaaaaaatgttgattacttccggatgagctttttcaatttcatcaagcaaaataatcgaataaggatttagtcttactttatttgttagattaccaccttgttcaaaaccaatataacccggaggagccccaattagctttgaaacactatgtttttccatatattctgacatatcaagacggattatttggtttttattattaaataaattaagagctaaagctctagcaagttcagtttttcccaccccagttggtcccataaagaaaaatgatgaaattgggcgggattcatcattaattttagctttaaaccgcaaaatcgcatctgaaacagccttaattgcctgattttgacccttaagcgattttgctaaatttttttctaaattcaaatatttttgaatttctgattctaaaagtttttcaatcggaatttttgttcaattagagacaacctttgcgatctgactttcgtctagaacattggaaatttcctgccttcttgctttaatttcgcctaattttttacttattttgggaatttttccgtatttaatctcggcggctttttggtagtctccttgttccattaagtaattttgttgatattttagtttttcaagttcctgggataagctagcgatttcagaggctgatttttttgattgatcccattgatcttgtaatttttttacttcattttcaagattttcaattttggattttaattctgaattatcttgtttttgcgagttaatttcttccatttttaaataaattagctcgcgctttgctttttcaagtttttctggttggtagttgatttcaacttttaaagaagcagcagcttcatcgactaaatcgatagctttatcaggtagaaagcggtcaaaaatgtaacgatttgccgcttttgtagcaaaaacaagagcagaatccttaatttttacttgatggaaattttctagcctttccttaattccccgtaaaatattaattgtatcaataactgaaggctctaaaatttctactttttgcattcttctttcaagggcgccatctttttcgatatataagcgatattcggaatttgtggtagccccgattaatttaatctgtccgcgagccataattggttttaggatattggcaaaatccattgaatcagtcccagaagatcctgttccaattagaaggtgaatttcatcaataaaaataataacttgatcggaattttgctcaatttcttgcaaaattgccttaattcgtttttcgaattcacctttaaaagaagcacctgcaagaattaaggttagatctaattcaaaaatttgtttattttttaaattatccggtacttgatttgcaataatctttagagccattccttcaacaattgcagtcttacccactccaggatccccgacaaggacaggattattttttgtttttcgggataaaattttgataatccttctaatttcgtcatcgcggccgataacaggttcaattttattttcttttgctaattttgttaaatttcttgcgtatttttcaagattttcgagtttttgtttcatttttttcctttttaattttttatttttcttaacaaaataaattataacatattttttggcacttaaaagtaaagagtgccaattttttttcttaaatgaaaaaatactttaatttaaaggataatttaaattttttacctttaaattaaacgaaaaaatgatataattgattaatatttattatgaaaaaaattattattggaaattgaaaaatgaataaaaccgtaagtgaaacacgtgattttattcaaaaatttgacattttctatcaggaaaatgtgggcaaaatcaaagaagatttagattttgcaatagctccaagttttatatctttatcactaatttctaagtccttgactaaaaaattagaaattgctgctcaaaatcttagtcagtttgattcaggagcctttactggggaaatcagtggcaaaatgctgcaggatttagggacaaaatatgtaattattgggcattctgaaagaagagaaatttttaaagaaaaagatgaagaactaaaaaataaaattttacaagcacaaaaatatgatttaattcctgttttttgtgttggtgaaagtcttttagaatttgaagccggcctaactaaaaaagtgataatttcgcagataaatgctataaaatcagttctaaattttcaaaaggcaattattgcatatgaaccaatttgggccattggaactggcaaaacagcaacggctgcaatagcagaaaaagtttgtggactgattaaggaaaattttgggaaaaatacaatggtaatttatggaggctctgttaattctaagaatattaacgagttagtatcccagaaaagcatcgatggcgcccttgtaggtggagcctctcttgatccagaagaatttggaaaaattttagttaatagttaattttttacttttttattgtataatttagaaagatttgatttattacttggttttaatagttttcgcggattaatactaggttttaaatttttaattaaatttttgaaaggatttcaaaatgatatcaaaagcgagaaaacaggaaattatcttaaaatttgggaaaaatccaaaaaatacaggaaatacaagcgttcagattgcacttttaactgaggatatcgaaagattaaaactccattttttaaaaaataagaaggataagcattcaatgcgcggttttattgccaaagttaataaaagaaaaaaacttttaaattatttaagaatcaatagttttgatacatataaggaaacaattgaagccttaaatattagaaaataaattttttcttgttataaatttcaaaaaaatagtggtaaattttaaccactatttttttatttaatttaaaaaataagtttaattatttttatataaaacatctttaattttatatggtataattataatttgcacaagtcaattgcagatataattaaatataataatttttttataattgttatatttaacaaatttatatttgaggaaagtccgcgctagcactacctgagatggtagtagtgttcatgttggatctaataaatccaagctttagacgaccagtgccacagagacgagtttatttattaatttgtttatattaaaaaatagtttagaatttttaaattaataaataaggtgaaacgcggtaaactccatgagctagaaacctaaattttggtaagggagcccaatttcgggaaacaaactttaattgggaagttctattataatatttttataaagaacttagataaatgattgattaatacagaacgcggcttattagtgcaaaaaaaacagcgaatctagacgctgttttttatttttgaaaaatataaactatttttttgtttaattcttatcaactatataagcatcaataagcgcttggcgaatttcttgattattaatgtttgatccaaatactaaatttttatcatttgacatcataaacgctttgaatgttactggtgccttttgagtttttggatcgctatcagtagctccaatttgtaattcatttaaaatatcagtaaaacttgggattgggcttacaccttctttggctttgtctgcttttttataatgtaaacttctatgcattctactttctataatttgtttatgattttttcctgcttgagaagaaaatactgaaacagaaagtcgatcattgttttctacaacctctaaaagaatttttgtattcgccttgataaattcagtattttttttgtttttatacttgttaaaatcaattaaaagtgagggtgtgtccaaaaaactactattattttggtcctgttttcatccaaaaataaatttgataaaaccgtcgactagatcaacaatatcagtaataaaattattttcattccttccaggatattctagtcctaattgataaccagtttcatccttgaccttgtatttgttaagaattattccatttccttttccatcggatattagatgatgatttttgaaatctgttatattattaacttgaagcgctagtcaaaacactccaatatcatcctttttattagtcttttgtgaagtagtagaagaagagttcgttgttgggcttaatttcaaaggtttccttagctctaaaccttgatcagtttgaattgcatcttctgatttaaatattaatttattatcacttaaatcttttaggataaattcttttttatcttttccttgatcttgataattaattgttccatctagaaatacatcgggattgaatttcttaattatatcataggcagatttattagaattaataatattattaagactaattttggactgggccaaaattagattttgattagttttatcaactaatttaaaatcaaaaaatagcttatttcctaaagttgagatctcatattcgctttttgtattttcaagtttataaatattagcgaaattaaaagctgttcaaatgcttgtcccaaatttttcattttctaaggttaaattcgtactgcttgtggaattagaattcgaattttgactagtttgaggggatgaagtggaaactggttgtgtttgctgactttgactttgtcccttagcttcttctgcaaaagtgcttaccttgactgtttttgctgaattttctgttgttttagctagtgaaacctctggttttttcggttgtgtggggctatttttttctgttttttgagtatttgcctttgattttaagccctcaatcacagtttttactcttgttttactttttcctggtcttggtcaactaaatattttcccgtatttaataaataaatgcttttaagaacttcttcacttggattttccaaattagtcactgtttttgctagttcaaaaagtcgatcaactcgctgttttatttcatttgaggataaagtttttgcatcttgatcttcaggcattgaaaattctttaactgcttttatcgttccaaacatttgggcaacagcggcttggtatttattaaaatcaacttttagatcaacaaaaactggaagatcctggatgataaattttttatcaatagcttttcgttttaaagaagcagtaatttcaaagcgaattttttgattttcagctagttttttcttatcaacaacagaaatctgacttggatctaaaagtttgggaataatacttaaatagacagttccgattttggtattaagaaaaaaatttgactcacttaaatcaaaaagatctttaaattctttactttttgttaaaatttgggatgtatttacttttgaattcggagatccatatcaataatcagagaggctaattttatcttttactagtgccatttgcaaatcatctttggtttttaatttgccttgaagatttgtttcaagtcaggattttagaattttagaaatttcctgatttgaaatcgcgccgcgaacttcaagatttaaattcatagtttttttagttgaaatttgcactaaattaagtccaagaactaattttccatctttatttaacaaagttaataatttttttcgatccaaaactgggtctaattgataatctggacctaaaaatacgggttctcctaaggaattataaagtgaaagactcgcttttgatgcaaccaaggctctttcaagtcgtgaaaatcaattacttcctctttcattttcaaaattttgggcaagcaaaatttggaattccatcaaagttagatttgcccttgaaagatcgacaaaagacttgcttgaatcaatttggctaaaatcaaaattagttctagcttgttctgtatttccaaagcctttaagtacaatttgttttgaataagttatttgatccttatcagattttgcataaataataacatttttaattgaattttgatcaactactgcattttcaagatcaaaacttactaaataatcattgtttattagttcacttaaatcaaaagcagaaacaagattataacgataaagatcacttttggcagcagttaaaactgtttttgccgatcattttttaaaattatctttaattttaagatttaaaacaattgaatcaaatttttcctgactaattttagctttttctgttacttttagctgacttgggatctgatttagataagaataatatgatttattataagaattaattccgacaactataccaacagcggctgataaactaagactaattccggcaattgttgttattaatcaaaaaggttttttaagtaattttgctaacttcataggataaatacctccgggttttatttagattgaggagattatgctggtaatttactttaaaaagtttttttattgagctcgaaaaagggaaaaatttgcttgtcttatatatttaaattataaccttttttttattttttttgtattttttgttaaaaatttagattacaagcttttttataggtatataaattttttagacttaaaaaatttatgaaaaattatctaaaaaatattatttttggaaattataccaaattttattaatctgagaaattttatcaaatttttcagctttttggctaattgcttttgaagttaaaagcgcagtaaaaaatgaacaatactcagttgcataaattttattaccttggaatttattaagcccgacaatcattgtatatttttcattatttcaaactaaacctctaaaaaaataaagtttttttgtatataaaacttcttgaagcactagtgtttgtttataatttccttctagaaaaccaagataatattcccatactaacaattttgctttaatttgatttaataaactacggtttttttgcaaatctcatttttgaaaactgatgaatttttgctgtaattttccattataaattaaagtaagaattttttttgtcggtcagttttttaagaatggtatttttcttagacctatcccgtgcggaaaatcaagcaaattaggtctaattgcaaatattttttcagtttgactataagcaattgcaattgtatataaattctgaacaacattttcgtatctttgaagatttagctcaattttattaattcatagactaatcttgttcatctgctattataaaataaaaaaatcctttaataatcagtttatcaaatttaaggaaaaattaggcaaaggcaataaaaaaggaaaaattagaaacttttagctaatttttcctaaatttagtaattttgctctgaaaagaatataataaaatatctaatttaaataaaaaatctccaaattaatatttggagattaaatttgctatatttttatagatttttattaattattgttttatataattactaataaaagcattatttattaaacgcattttttctgtatcgtttgtaaatgattttttatcaaataatgctattgcttttatacttacagctggcggttgggtttttgggttttgaggttgactatctccaattttattaggactaaataaagaatataataatgaaccttgaactgtataaccttgagagggaaatgattttctattttttattttaacaatcttttctttgttattatcttgtgctgaaggtagtgaataaagctctgttacaatatctttttttgacttataaactactaataaataatcagcgttttgacggagaataatttttttctttgatcgaggatcaattgaaccacttgcatctaatatcgtatcagcagcctgaaattgtttatccctgaagtcatcaggctcatatgaatcaattctaatctcaaaagcgtttggttcttccttatcttgatatctctgaatgaagacacctttatcatttttatctcttattagataatgaggtttataatcatttttattgatattattaacggtaaatgcaatataaattaatcctgatctaagtcctggtagaggttttttttgctctgcttgtgtttgtaattctagtttgagtacattttcttgtggattggatccagtttctggtttataaacaaagccattacccattaaatctcttaacgattttaaagtataatctttttttgcttgctttttataatcaggttgttctcctattgttgcatcaaggaaaagatctgggctaaattgtttaatctcatcataggcagacttatcagaattaattagaccaccaagactaattttagatccttgataaataattgctcgatctgcttttgatacaagcataaagtcaaaaactaatttatcatcctctgttgagattgtatattgcccttgggtgttttcaaaattataaatttgcgctgtatttagtaactttcaaattgtatgtccaaatttttcttctaaagctattgaactttgtccactgttttggctaagacttgattttggactctgacttgtagaagaagcttggacctgaccgttcttagttgtttgttcaggttggtttttcatactaattatatcagaaaaagcacttactgaaacttttttttctgtccctgttgatgtcttagtagttccactagaagttgcagatgtagttggtttttgaataggactaggcacttttggagccaaattcttggtgtcagctttcattcgggcttgttctattatttttttaagattagttttttcttgctggatctcatcatcaaaaagatatttccctgtatttaataaatagacagcacgaacaacttcatcacttggttcggataaattactaacttttgcggcaagatttgctaatttatcaattgtttctttgatttctttggttgataacttggctctatcttgatattcttgcattttaaattctttggttgtatttgttgaattaaaaatttgacttaaggctatttcgtatttattagaatcaaggcttaggtcaactaaaactggaatatcactgagaacatcttgttgatcgagtgcttttctttttaaggtggttagaacttcaaaacggatttttttatcagctagaagttttttcttatcttcttgactaatttttgcaggttctaaaagttggggcttaattattacataaaaagttccaaattttgtatcctgtcagaattttgctgacctaaaaccaaaaagatcctttaattccttagctttttgttttacttgatcagttttagttctttgctgtggacttccgtataaatactcagaaaaactggttctatcatggaaaagagcattttttagttcaagatttaggctaagattttggtctaaatttgattcaaataaagtttttaactcactagtaaattcttgatttgttaataatggacggatttctagtgttaaattaattttcttttggctctctttttcaactaaattaagttctaaatacaatttcttatttttttctagtaaatttaattctttttttgaattcaaaactggttctaagcgataattttcatctaaaaatactggttgccctaaagaattataaagtgaaagacttgcttttgaggaaatcaaagcatttgccaatcttgtaaaagaatttgcatttcttatttgtcgataattttcgctaagaattctttgaaattcagaaaaagaataatcaaatttataaagattaacaaaggattttctttgatcaatttggaatttaacaagatcgcctgcagcttcatcatcttgagcaaaacctttaagttcaatttgttttgaataagttatttgatctttttcagattttgcaaaaactagcacatttttaattgaattttgatcaactactgcattttctaaatcaaaactaatttgatagttgttagtttctaaacttgaaaattcaaaagcccgaactaagtcataccggtataaatcattttttaccgctgataaagctgtttttgctgatattttcttaaaattatccctaatttttaaatttgagactattttatcaaaatcttgttgggatatttttgttgttttagtagtttttagctgacttggattttcatttagataagaataatatgatttattataagaattaattccgacaactataccaacagcggctgataaactaaggctaattccggcaattgttgttattaatcaaaaaggttttttaagtaattttgctaacttcataggataaatacctccgggttttatttggcttgtttattttctttttttctaatgagaacgcgaacataaagtgttgatttttttgctgccggggaactaacgggtttagccgcaactggttttgtagtttcaggctttgctgcttctgtttttggagtttcaggttttggagtttgttctactaatgcaaagtcaaggaatttatatcctccagaaaatgcttctataattttttcaacctcagcagagtagttttttccttttgatttaagggatttttctacttttgtacctaattcttgaatatattctgttagcttattgctattttcctctggttttttagattgattaggagcgccttcggcttttttaccttgatttggagttccttcacttttttgggttttgggaaaagttaaagaagaaaatgcagactcatctaatcttcattctttaaattcgctttggagttctaataccgttttatctaattctttgataattttattttcttgataatctttatcggtctgaagttctaaaaatactttaatttccggtgtttttaactccgattttgctccatcacgataagaaagtttaaattcaaatgaaattggaagataatttccttctaatgaagacgaagaaactgaacttgttgttgagcttaaaggttttgcagcttctggtttagccgccacgggtttagctgtttctgattttggcggaactggcgccggtgaactaattttatctgttaattccttaacttttttatcaatttcagcttttttgccctctttttcttgatctccttttttcggcacaaacgaatatttaagattatcatctaattttgctcacggagcaaaattattaaattgggcagcctttaggaaaaaggcttttaataaatcaccaaaattttcaaagtcttccccttctaaaagctttttgtcaatatttctagttttaaagccggaagaatcaattaaagaatgtttttttaattctgcaaaaacttcagcatcagttttatttgctagtttatccttgatttcttttggcagaactaaagtagcataaaatccttgacccttttcattgcgatatagaccattaaaagtaagtttggttatttttctaaaattttctttaccttttttacccactaggaatttatactgtgttgcttcctcaaaaatgttttttgcatttctaaattttcagcgtgggaaattagctgtatttgtatgaagtccccattttttacctaattcataaagagtttctataactgttagccgatcttttgttagtaaatcctgataaaaactagcaacttgatgcccatctaggaaaaaatcacgtgataaaatttcagcaattccgacttcggatactgccgctttttcattttcccttaaggctttaatgttttcaagttttggctgtactaaatttcctgttcaagaatcaagtaaagactgataaggattaaattgataattataattagtttcaagtactttatgaattgcttctggtttgttttctttaaaaagtgcatcgacttcaactttagcaattaaaagaggaccatttatcggttcacccccaaaatcaactaaatcttgattttccttacctttttcaaaaaatggtaaatattttgttttataaatttcttgatttatttttggaagttgattattgagcccttggtcaaatccggttagtttaaaaattccatcttttcgagcaatgatattctctggtaaattagttgaagttttgaaaaaactttcatcaacttttagacgaaaaggaattaaaattgttgatttatcagttttatcaagacttgccctttttacatctagataatattgaagactttcagaatttcccttgccagaaaaaattgaatctaacttgccaaaatcaaatttaattttattttttaatattttattaattgattctttggcttgatcagaacgaagatcgttattatcaaaaaaaccagacctaattgtactaagaatttcataggccgaagtttttaaaccttgctcattaaaatcagttttggtaatatcttttaattttaagttggctaaaaactgattaaaatctaaaaagtaggaggaattgtcttgtttttgtagtttaattgatgaaactattgggcgaaaattaaaatcttgaccaattaaatcacgagcactttgactaagatctgcttctaaaaatagaaatggaatttggttctgaacgctgacatattgattagttgcctgtgatctgcgaagactaaattcgaaaatatgcccagaatttccgggtagtttattttctgaagattcatttagctttgttattaaattatcaagtgaaggaaaataaatagcaagttttttgactaattcttcggaatttcgtgcctgatttagatcttcttgaaaatcaagtacgcgaaaacttgccggatttttataagaggatgtcggttttgttaactttgctaaatcatcggcaaagtttgtagattttagggatagatttcctacttgctgatttaatttatcagtgattttcttaagtgaaaaattaaattcggcaactaaaagatttgactgctttaaaaaagcgacactttcttcttgataaatatcagattttgctatatccccgtttgcaaatttttgtcataattgaaatttgactttaaaattttgattgacatcatcagggataatttcaagaatatgaaaggaaattccggcatttttatattctggatcttcaaggttaattttttctaactgatcaccgtttttagaaaaaaaggaaaaggattttagaaccttttcgctatttttgatttggttcttggaatctaaaaggtgatttttgattgttcaatagtcagaattagcaaaaaaagcatccggactaaaggataaagttgaaacttttgtagcaaaatcatttacaactttccgtggatgctctgatctgtattttgccaagctgctaagtccgacagttagaccaaaaactccaagaccaataatagacccaaccaaaccaattttaaaagttttcgattttgtcaatttactcatatttaacctctttttttggtggtatttttaaataattttttagttttttgttttttgctttttttatatataatataaattaaataaaattgttaaatttttattatttaattttcttattttttatttaaaaaactaaaaaattattcaagctgtacaaacaaaattataccttttttttttttttttttttgcaacaaaaaaaacaaaaaaaacaaaaaaatgcccattttaaggcacttttttcaaaaaagtttaaaaatttaaactagtagatctagatatcaacttttgcatattgcgcattttcttcaatgaaaattttgcgcattgttacgtctgttcccattaacgaatcaaaaacctgggcgactacttcaagatcatgaatttgaacttgatacattcttctagtctggggatccattgttgtctctcaaagttgttccggattcatttcgcctaaacctttatatctttggatagtaaatttggaattttcctttaaaatttctgttaaatatttttctttttctttttcattataggcataaaaaattttttttccttgacttattttatataaaggcgggatcgcaatataaacaaagccaaattcaattagctttttaaaataacggaacaaaaatgttaataaaagtgaacgaatatgcgacccatctgagtcagcatccgtcataataattattttttgatagcggattttactaatatcaaattcaggaccaactcctgttccaaaagcggtgatcatcgatagaatttcttcatttttaagtactttttcaagctgaaaccgttgggaattaataacttttccccgcaaaggtaaaatagcctgaaaatgtcggtcacgccccatttttgcactgcccccggctgaattcccctcaacaatataaagttcggcgatctcggaattttttgttccacaatctgcaagttttcctggaagagtcccaatatcaaaagcagatttacgttttattgcctcacgggcagattttgctgctctggctgctttttgtgcaagcagatttcgggcgataattttcttggcatcctcaggattttcggctagatatctttgaaaaacctcgctaaaagctttatttacaaattgacgaacctctttgttgtttaattttgcctttgtttgaccttcaaaaattgggttagtatgtttaattgaaacgattgcaattaggccatcttttatatcttgtttgacaaatttatcagtttcggatttgataaatttgttactaagtgcataattatttagaatacgcaaaaggccatcacaaagcccattttcgtgacttccgccttcagggttatgaatattgtttgtataacttttaatttgactatgatcttcttggacataattaagggcaaattcaaccttaattgtatcctgattatgctcatattgattctcgctataaatgattgtattagttaatttcttaaaatttttacttaattcttcgacataatcagaaattccgccctcaaaacagaaagtttgggaaaaatcactccgtttatcaattagttcaaattggattctacgtgttaaataggctgtatttttaagacggttaaaaattgtaagtaattgaaaactgtttttttcaagaatctcaaaatcggggctaaaaataattttagtcccactttgggaactatcaagattagaaattacacttaggtctgctgttttttggccgccgttaatgaatttttggtatcaaagtttgccatcccttttaataaaaacctctaattccttggataaagcattaacaaccgaggccccaactccatgaagaccacctgaaaccttataggatttaccatcgaattttccaccggcatgtaaaactgtaaatacaacctcagcggctgaaatctcatattttgggtgaattccagtcggaatgccgcgaccgtcatcctcgatactgattttgaaatcatccaaaattgtaactttaattttggatgcaaaacctgcaagagcctcatcaactgcattatcaacaatttctcaaaccaaatgatgcaactcgtttattccggtcccgccgatatacattcccgggcgtttgcgaactgcttctaaaccttctaagacaactatattttcggcttgataatcttttgacattagcttctccagtatttataaattaattattataccacaaaattccaaaaagccaggtggtttttttatataaaggaataaaaatgctttaaatttaaagtgttttttctttttggaattttcaattttttaatatcttggcttagcctcatgaatttttttctttaaaattcaagaagaaaagccattaaaacctactgttttttctaaaattttttttagaaaattagaaaaaatttagaaaaagaaactaaattattgattttttttaattattgattttttaataaaaattaagagaataaaaggcttaaaaattaaaaaaacctttaaatttaaagatttttttaattttgttgagctaaaagttttaacttcgcatttgctttttttgccgcttttgaagttttaagtcttcttagttcacgtcttttggccatttttaattttactatttttcgcattttaatcctttaattttgattgattttattaatttcaagcactaagtcgtttgtttttctaacaggttttgatactactttcgcaatatcaaaagtttggattttaccatctaaataactaattgcaagacctgatttatcttgattaattaattccatagctttcattgccatcttggctgctaaaattcggtcaaaagctgaaggcctgccgccgcgctgggtatgtccaacttctaaagagcgagtggaaatttttgttaactcctcaattttagccgcaaactcttttaggtttggtaaaatattctctgtaattgttactatcacgcttggtttgccttttgcaaactgttctaaaactttttgacttacctcttcaggggttaaaatatttgtattagtaattaaaatttcgcttccagttgccattgccgaatataaagctaaatcttgacaatgtctccccataacttcaactacaaaacaacgacgatgagaattcgccgtatcccttaatttatcaatagtttcaactatcgtattcaaagcagtatcaaatccaattgtataatcggtaaactggatatcattatcaatggttcctggtaaagcgattacttttattccttttaaatgtaatttataaccgccattataggttccatcgccaccaactaccacaagcgaactaatcccaatttcacttaaaatttcaacggctttattttgaacttcctcttttttaaattcaggaaagcgacttgatcctatggcagttccgccaaaactagaaattccattataaggaaaattttttgctggcaatatttttcttgcgattattccagaatagccatcaaaaattaaatatggctcaaaacctaaactaagtgctgattttgccaaaaaacttattgcagaattcatcccaggcgcatcgccgcctgaagttaatataccgattttttttgacattttaccttaaatagaattccttttttagatatataaataaaataggacaaaaaatttgaaatggtacgccctagaggatttgaacctctgacccaatgattaaaagtcatttgctctacctgctgagctaagggcgcatttggtgctcgaaactggactcgaaccagcacgggattactcccaaaggattttaagtcctttgtgtctaccattccaccactcgagctgctaataattttctgtttaggaattataccataaactgaaaataaaagcaaaaatttattttttaattttaattatgtatgactacaaaaaaattataacataaattatttttttttctaaaatttttaataatttaataaaaaattagtaaattaagatgtattttactaatttttagttaaaaattaaaaaatttttaaattatagtaaagtgaaatgaaaatgaaaatttgaatttttttaaagttattttttttcctacctgctttttttctaagtagttgctttaaaattgactttaatcttttaaattctggttataaaaaaaaattaaattccacttcaaaattaggagaaacctttatttttgattctgttatgaaaggtctttcaaaaaattttaaaaaaccgcagacaaaatacaacggatttttaacaaaagaagttattcaaaatttaaaaattggacaaataaaaggtgaaactaatgaaaaaccagatgaatattttggtcttgaggaggtcatagtaaaattttttaatacacttgaaaataaggataattttgagaaaaaagaacaactttttttattattaaaacaaaaaattgagactacagatttcaaacttaatttagaaatcaaagatgataaggaatatgttagccaaaaggatgccaaaattaaaatagaagatccaatttttaatgatcaatccgatagggatttttatattgaacaaaaagaattattcgaatctgataaagatttgaataaatttcttgaaaaaaagaaaaaatacctttttcttgaggaaaaattcataaatgaagaaaaacagtggaatcctgtaattaaattaatttttcagttaaatatggcgcgttttcacctagattttattcaggcaacccaaaatatgtctaaaaacattatagtttcaataattgattatattataaattttgaaaaaactaaaaagcaagaagaagaaaaacaagccgaaattaatatacttttaagagaaaaagagcgaatagaacttaaaattaaagaaaaaacctcagaaaaaagtaataaaaatgatgaaataactagaaaaattgaagaaataagtcaaaaaatcattaatttaaatggcatacttgaacaattaaagcaaaaaaacttacaaattttaaagaataatgtcagaaaaatttgtgattttttgacaaatttttttgacccgatttatcactattcaatgaaaagtgactatgttttccagaatgaatctgatctaagagttaataatcaacttgcttttagcaaattttttagtttttttacaaaaaatttaaaagaaaaactaaccaaatacggtatcgaatctccctttgcaattttagaagaagaaaaaacaaaactaatcgaaaaatattttctacccttgatttaaatttaaaaaaattacattaatttaaagtgtttttttaaaatatggtataattaatcttccaatttgctcaaagggggagataagatggaaccagcattagcaaaaaaaaacaagtcacagaaaatcaccttttttggcgctcttttaatcgtgcttggcgcaagtattggtgctggaattttctttaaatcaaagtctgttttggaaaattcaggttataatttggctcttgcaatcggaaactgaattattgcttgtttttcaattgttgcaatggccattgctcttgttgaaatttcatcagcaacaaaaaaatctaatttatctattattatttgaaataaagtctttaattctcaagctttttttcaaatttcaaaaaatttcattatttatctttatctaccatttacttattttgtcctccctgtttattttatgcaaattttccaggacgcaattgcggcttttcgccttgattcaagcgggcaatgaaatatgaattcagactgaattattgtccttgctgtttcaattttgataacaatttatttttttatcattggattaaatacaaaaattgcagaatttcacaataaattatttctttttgcgaaatttttaccaattttggtaacaataattgttggttttgtatttttttttcaagggggatcaagtagattatccaataattttgattttttaccgatagaaaaaataaaaacagaaggagcatcaattgcctctagtttgccaggagttggtgttttaatttcgatgtcaggaattttcttttcatatgaaggattttttactgctgctggtttacaatcagaaatgaaggaaccaaaaaaaacaccaattgctattttattaggtattgcaattgcaacgataatttacctttttattgcagttgcaacttcaattgttggggatggatcaatttcatcttttattcaaattgcaaaaaacgaactaaattggtcaggtttaactattaaattaattttaggaacaacttttttgctaattggagtcagtttactcggaattattaatgtttttactttatgaggtccacgtgcccttgaagaattaattatgagagatgaattttccttactaaaaaaatggaaaaaccgtataaatttaaataaacctaaggtttctacagtttttttatgtattttttctgttatttgcttaattatttttacattgattggtgtttttgcttttgatgatcaaagttatggtaattatggtgaaaaattaaataatttatattcatttgcagatattactggaaattgggcggctttaattagttttctattaatcgccgcggcaatttatggttgcattcgaaaccgaaaaacgcaaaaaatagccgttcagaagcagcgttattttctcttttttggctatatttcagtaatttttattactatagtattaatttttgcaatttttgccccaattatagatttgattttaatttttagctataaacctccaattcccgaatttagtcaaattctaaaaacgcgaataactatcgttatcgtgctttttttgtttatatttgtcccggttttgccggttatttgaaattgatggcaaaaaaaattaaaaattttcaacaaaagacaaaaaaatagtttataatataagaaagttatgcaaattaacttagaaaaatatattcgaaccgtcgaagatttccctaaaaaaggaattagttttaaggacatttcaccattacttgcggatggaaaagcactcaattatacaattgtcgagatggcctcacttgctaaagatgttgatataattgttgggcctgatgcaagaggttttttatttggcacaccaacagccgcttttctttcaaaaccatttataatgatacgaaaagctggtaaattaccaggcgaagttgaagaatttgcctatgaattagaatatggttcagcaattcttgaagttcaagttgatatgattaaacccggacaaaaagtagcgattattgatgatgtgctagcaactggaggaactgtaaaagcaatcaccaaaatgatcgaaagagctggagcaattgttgataaaatcatttttttaattgaacttgaacaattgcaaggtcgtaaaaagctcgaaaattacgatgttatttccctaataaaaataagttaaaaaattttaattaagtttaaatttttaaagttttgactttgtttataagtcaaaactttttttatataaataataaaaactttaaggtataatttaaatgtaagtttatttttgaactcgagtgaaattttttcttatattttctcgagttttataaaaactacgaacaaaatataaaaaaggagatatatggacaaatttcgctatgtaaagcctggtcaaattatggcaaaagatgaagaaatgattcgctttcttgatattgatggtaatcttttatcttcaactgtttttggaccaatcgacgaaacaaatgatattcgcttatcaaaacaggaaatcaaaaaagcttatgaatttatggttttatctcgccaacaagatacgtatatgacacaactacagcgacaaggtagaatgttgacttttgcccctaactttggtgaagaagctcttcaagtagcctcagggatggcgctaacaaaagatgactgatttgtcccagcttttcgttcaaatgcaacaatgttatatcttggcgtgccaatgatcttgcaaatgcaatattgaaacggtagcgaaaaaggtaatgtaattcccgaaaatgttaatgttttacctattaacattccgatcggaacgcagttttcccatgctgccggaattgcttatgcagcaaaactaacaggtaaaaaaatagtttcaatgagttttattggaaacggggggactgccgaaggcgagttttacgaggcgctaaatattgcaagtatttgaaaatgaccagttgttttttgcgtaaataacaatcaatgagcaatttcaaccccaaataaatatgaaaacggtgcctcaacaattgctgcaaaagcaatggcagccggaattcctggaattcgtgtagacggaaatgaccttttagcttcttatgaagtaatcaaggaagctgttgattatgctcgttctggaaacggtcctgttcttgttgagtttgtaacttgacgtcaaggtgttcatacctcttctgataatccacgaatttatcgtactgttgaagaggaaaaagaacacgaaaaatgagaaccaatgcaccggattgaaaaatatatgtttgaccgcggaattcttgattctgccgaaaaacaaaaaatttgagatgaagcgcttgcgattgtcaaagaaacttatgaaaaatctcttgttgggcttgagtcaacaattgatgaaattttcgatcatacctacaaggttttaccaccagaacttgaagaacaaaaacaagaagcgcttgaattttttaaaggagtaaaataatggcaaattcagataaaatcgctcttaataacatcggtgcagttacaaatgctcttgatttaatgatggaaaaggattctcgcgttgttctttggggcgaagatgccggatttgaaggtggggtttttcgagcaactgaaggtcttcaaaagaaatacgggattgaacgcgtctgagattcgccaattgctgaggcttcaatttgtggagttggagtcggagcagcaattgctggacttcgtccagtcgttgaaatgcagtttcaaggattttcctatcctgcatttcaacaactttttgttcatgcagctcgttatcgaaaccgttctcgcagtcggtttagtgttccgatggtaatgcgaatgccgatggctggtggtgttagggctcttgaacaccattccgaagcaattgaagcactttttgcacatattcctggactaaaagtggtgatgccttcaaccccttatgatacaaagggacttttaattgccgcaattaatgacccggatccagttgtatttcttgaaccaaaaaaaatctatcgtgctttcaaacaagaagttccagccggaatttacgaggttccaatcggaaaagcgaatgttataaaagaaggttcagatcttactctggtaacttatggggcacaagttcatgaagcaattgccgcaattcaacaacttccaaatacaaagggacttgaagaagttgatgttgaactaattgatctaagaactattaaaccattggatactgaaacaattattgaatctgttaaaaaaactggaagaattttaattgttcatgaagcagttaaatccttttcggtttcagctgaaattatttcccgtgtaaatgaaaaagcattcgagtatctcgaatctgcacctgctcgacttaccggttatgatattactgttccacttgcaaaaggtgagaatttccattcaataacaaaagaaaaaattattgacaaaattcgcaaaattatggaatcataatttaatttcgtttaaaaacttaataaaaacattcagaattcaattttttaattctgaatgtttttttttttttttttttttttaagatgaagaataaataacggactctaaaaagagaaatggggcggatgacggggatcgaacccgcgagtgtcgggaccacaacccgatgcgttaaccacttcgccacatccaccaaatatggaaaccttatttattataccatattttttttaatttgataatcaaattgtaaaaaaaattaaaaaacactttaatttgaaggggtttttactaattaaatatgcaaaaaacgaataattcttattaaatattaagttgaaatttttgattttcaataaaaaaaaattaaatttttattattttttggttcgttgtttagttaagaacttactaaatcattgaaatttctaaaaatttcaatgatttttatgttgtattcacatttttgtacctgaaaattaccagcttaaatttgtctttttttttttttttttttttgatttttcttaccttgatatgtatgttaacaaataaaaaatactttaaattaaagtattttttaaattaaagttaattaagccacaaaaatttataacaaaaaactattttgggtaatatttactaatattttggatatatttagtattcaacaaacaatttttcattacttttgttaaatataccataatctttaatctaattaatttttataaatctttgacttttaaaaataaaaaaaataataaacaatctaaaaatattattgtataattataatattaaatttataaatagaggttccataaaaaatgaaaagtttggaattaataaatattttaagcttgggaaatgttgttgtatcacaaccttatgaaaatcaaaatttaatgcttaaaaattattttctcaaagctgaagcttattttttagatcaaattcaagatgaagaaacaagaaatttatgaataaaagagtttgtttattctatagattctttagatagttttaattataaagaattaaattatatctttaaaaataaaatttttaaagatcaagatcaaaaaaatgctattttccaaaaaatcagagaaaatagtaaaatttataaaacatttcaagaacaaaaaaataaaaaatctcgtagaggaaaaagaagtttattcaccgaatatcaacgtttaactattcaagattggattgatataatccaaacagctatcgatgataaaaagggagacgcaagacaagctagaagtgatggaacctcttatataacctctggaatttcaactattacctcaacttttgttggcggattatccagcccatttttgtttgctgcatccacaatgggactttatggaactatagtgggtgggggacaactaatagctggaggtgtttttggtggttattattataataaaaattgatataccgctgaaaaattaagtaaaaagctgacggaattaaaaagaatttttagaatcattaaaacctcaaataatacaaatttagaagaaaaattaagaaaagatataaaacaaattatagataaaattaatgaattaaccggagatatgatagatttcgatgattttgacaacgaaaaaatcatcgaaaatggatactaaatttgcaaatgaaatctgttagtttattttttcgggtaatatttctaagtagtacaccatttaaaatcattctaatagtgtttctttcgggatcaatagggtgtgtgtttggtatttcattttttggtggatcatttgaaaaaggcgaacttttagagcttcgaatcccaatatatgcaataattgtgtgcagtttaatttatattttgataaaagcttttctttttcttaaaagatacaaaaaagaagctttatttttaacaaataaggaatttgaagaaaaatattataatttaacaataaaaccaataatttgaccagtttgattgcaccgttatgatgttcttattcgtgaaattgagcaaaatccggataaaattgaatttagtaaggaaaagaaagagtttttattcaaaattcactatagaatttatatatatgaatttatacttatttttttaggtttaattcttattattttactatcgattatagttgaaatgattccgaatataatcaaaaaaacgttatttcaatattatgataaccaaaaaaaccagactaataattcactaaaaggactgccacttttacttatttttataggatatactttttttacattcttaaattttgtgcttacaagaaattttctaactcatatttcttgtagtcttattaaaagtcaaattaagcatgtttataactcatacaaaaaaacacccgccatattttttatgccaaaacccaaaatttaaattttttaatcactaaatttttaacctcaaaaataaaaaagtactataaatttatagtacttttttaaattcagagactaaattagcttctattctttaccatcatcaggacttagataattaactttgatgttttcaacatcaaatgcaaattggaaagagttactatcgcctgcacgaattcggttaataattcagtaagtatcaacctccataattgggataattgggacaaattcgcggataattttttcaaaaataactataaaatcaaaaaccttattttgggtccaaccctcttttttctcatgttcactaaaaagaccattaaaaaaagcatcaatccgagcattatattgatcaagactttcttcatattcaggtattagaattggcttttgattaatatctagtgctttgtcttttaaatttttatttagaaaaacctctttaaaaatcggatttttttgattatctagcctaatttttcgtataattaactcctcaaattttgcaagataaataggagaaatttcatctgattaaaaatgtttttcaaattaaagttaattagaccataaaaatttataaaaacaaaaactattttgaatatatttagttttgacaaacaatttttcataacttttgttaaatatactataatttttaatttaattaatttttataaatctttgacttttaaaaataaaaaaatgataaacaatctaaaaatattattgtataattataatattaaatctataaatagagatacggtaaaaaatgaaaaatttggaactaataaatattttaagtttggggagtgttgttgtttcccaagcttatgaaaatcaagatttaagacttaaaaattcttttcttaaagctgaaacctattttttagaccaaattcaagatgaagaaaagaaaaatctatgaataaaagaatttgggtattctattgattctttagatagttttaattataaagaattaaattatatctttaaaaataaaatttttaaagatcaagatcaaaaaaatgctattatccaaaaaatcagagaaaatagtaaaatttataaaacatttcaagaacaaaaaaataaagaatctcgtagaggaaaaagaagtttattcaccgaatatcaacgtttaactattcaagattggattgatagggttcaaatgtttataaacaacaccaacaatagatcaaatacatctgaatcgatagctggtggtatgggtgctgcggctggaagttcgctggttacacttatatctacacttagttctctcactggtcctataggatgggttgctggtttaatatcaggcgcattaattattggattttcaggtttgagtggacattatattgggcaatcacttggtgaaagagacaaagctaatgacgtcgcaattttacttgacgaattaaaaaaaattttaagaattgcattaacatcgaatgataaaagagaggaggggaatttaagtcaacgacttaaaaaagttattgatgaaattaataaacgagctaattatataattgattttaatgatttttaccctcaatttcgtagcattaatactgtattaatacaagatataggaaaaaatgaaagcaataagtctcttcttttattctagcgttatccgatcaggcgggttaaaggtttcagcttttattttaattattggaatgttttcttttaatttatttaatatttttgcttcttttagccaaaatgatttattgtgaattagatgtatattttactttttcttaacctctccagtactttatattgttactaaatattttcgatttatcaaaaaatataaaagtgaagctttagtcttatccgatcaagaatttactgaaaaatattataaacttgtaacaaaacctttaagatacacgcgttttaatgcgataattcgggatttagaagaatttaatgaaacaattgaggatgaaactcaaaaaaaacaaatcttatttagagctcactatcgaatttttattttagaagctttggtaattttaattggtttggttttgtttttgctttgaattagtttgactgaagctagtctaataaatttaagtgttcttccaaaggaatacgataaaaatcattcacttcgaggcgctttttcatctattattttttcttttttattattatttttaattatcattagcgtttttacaagaaattttttacattatatttcaagtaatcttcttagatattccattaaaactatttttgattactataaaaaatcaccgtgacgtttttttatgaaatagtaataatgaataatcaaaaaacactttaatataaaggataatttgtaattgcttttttcttctcctaaataaaaatattataaaaaataaaaactccaataattttggagttttttaaattcaatcgcttttttttaaaatttctaattttatgaacttaaattttaaacgtgacctcatttacgtaatgtttttttagtttttgctgatactttaagtcgaattttttttcctgaggctgtttttagtgttatttgttgtaaattaaggttaaatttcctttttgttgcatttagagcatgcgagcgattatttccacttaatggtccgcggtgagaaatttggtcttttcttgccatttttactcctaaaaatttaattttaaaatttgcgctgcctaaattagaagattatttaagcagattttgcaattgctaatttaacgatattttcgaaatcactttggtgatgaattgccatttcggctagcatttttcggttaatttcgatatttgattgcttaattttatgcattaattgcgaataagaaatcccttggttgcgcgctgctgcattaattcgactaatccataatttacgaaaatctcgttttcgctgttttcgatcacgaaaagcataagttcaggatttaactactgcctgttttgctgttttaaaaccaatcgatttatgccctcaatagccttttgctaattttaatcaacggcgacgacgctgacgtgttatacttccgcctttaactctcatttaaaatatcctttctttttatgtatttttcttaaaagtgttttttaaattaatttttttagtcttttaaaatcagaattattcattaaagttgattttcttgattgacgtttttgttttgttgttttactttgagcgagatgtgaacgataagcatggccatgtttaacttttcctgttcccgttacttttatccttttttttaatgctgattttgttttaaatttgattttagacattctcttcttcctcttttttttgtttttcgtattcgagtaattcttttagttgttttgctgaaatgaattttgggagttttttgcgatcacgttcaagatgcataactaaaaagtttccattttgtgaaatttctttactttttttagcaatatattttaactgatcataaaagatatcaagtgtttttctgccttgatcaaccctagtaatttcacgaccgcggaaacgaagggcaattttaacacgatcaccatcaagaataaattcacgagcttttttcgatttaactaatatatcctggaaatttatattaaaactaacgcgaatttcacgattattagtaaaagattgcttttctttttcttctttttttttcttttttatatcataacgaaatttaccatagtcaagaatttttgcaattggaactttttgaatttgattatctttagttttaacttccttaatcgaaattaaaactaaatcaagacctttggatttagctaactcaattgcttcttttgttgcgattttcccaattttttcattatcagttccaactaaaaaaatgttgggaaaaagtatattttcgttaatttggtggtcttgtaatggttttttctggaaagggggtctgtgattcaaaatttaagttttactccattttagatcgtttagtaaatttttttttaaaaaaatttactaaaaaacgaatttaattttaattttggacaaaaaaataataatttttgtttgtcaggtaaacccaagatcactaacatcttcaggtgagatattatctactttctgcaaataaaaatttgcatattatattatacaggaaaaacaaaaaaaatattaaaaaaataaaaaattaataaacaaattgtaccattttttcgttttctaccactaaaaatgtatcacctttttcaaccccaaagggttctaatacatttcttgctagactaaaatcatttttaattgctgtaaattcagaaattgagttaattgagacaaaaacggaggatgtaattccaaaaccattaattaatttttcattattaatcacgccaattacggctgtatttggtctaaattttgcaatttcccttaaaagttggccagttcgagataacactactgtgtattttatttctttttcataggctaaatgcgctaatttatgggctatttttgctcttagtccccttgaattttccgtaattactgccagttgctttgcataaaaaagtttgttataaaattctttttctgctcttttattaataactgccattacctgaactgactcgattgggaactgaccctgggcagattcaccagatagcattgtcgcatccgcgcctaattcagttgctcaatagacatcagttacttctgctcttgttggttgggatgatttctccattgaatcaagcatttgcgttgcaactacaacagttttaccggcaaaacgacatttgcgaataattcttttttgttgaaatggaacttcttcataaggcacttcaagacctagatcgccacgggcaatcataattccatccgataattcaataatttcatcaatattttcaagaccaagtcttgactcaattttggagataatctggatatgtccgccgccgttttgatctaaaagtgtgcgtaattcacggacattttcacctgaattaacaaaggatgcagctatataattaacattttcattaatcccgaaaagaatatcatcaatatctttttgggataaaaagggtaaggaaaatgctacaccgggtaaatttagtcgcttatttgactttaaaatatgtgaatttttagttctaactacaacttttccgggctcaatttcgattacaactgattgtaattttccatcatcaaataaaattttatcaccgatttttagatccttatcaatttgatgagaaacagtaattatttgggctgttccttgaaaattttgataagaatctgaatctgttaggacagttaaacgttggtttgcaaggattttttgggagccttctaaaattttgccaatgcgaatttcgggtccttttgtatctaacataattgaaattggaatcttaagttcattagaaagcttccgggcgctgtcaaatttttgtttttgctcttgataatttccatgggaaaaatttgcccgaattacactaaccccagatagtactaatttttttaggacctcataatcctgcgttgaagggccaattgttgcgattatttttgttctttttgaaatataatttttcatatcgttcatttttttgatggcaactttctcgtattttgtattttgaaatggtttaaaaagtgcaaattaattaataataattataactaaaattaagaaatttactaataaatttctactatttttttaaaaaaaacatttcctagagcatcaaattgcattctctgagtcattttagacttatttatgaagatctcatagtgttttttgccttgattttcgggaataatgaggttaattgtttctaaattttcccaattaaatgataacaaaatttgcataagagacaaatttttaatttcaagtttaaaactattatcaaatttatcaaaattatttaaaaaatcaaatttaaatttataaaaatcaaagatttcttcaccatttttagcactaaaactagcgaaaatatcgacctgttttggtgagttcccgacaaaggcatatgtattaacactaatattttcaaaatgaaattcaagtttttcaagcaaattatctgcaaaacaatcagaggcaatttctgaaattgtacttggaattataaggttttttattttattattagcaaaaacagagctatttaacttacgaatcccctttggaaattcgatttttttgaccatattggactcaaaagctgaatccaaaattgtttctagattagcgccaaaaacaattttttcaattttatttagcataaaagctgactcgccaatttttaatagcgagtcaggtaaaatcaatttttttatttccaaatccattcccgaaaaggcaaaatcagcaatttcttcaaaattcaaagaggataaatcaagaatttttcccgaaaaaaattcttggtttttaataattttaattgcgatttcacggttaagtagtaaaaactgcacttttttcctaattttttcctttttttaactaatttggtttttttacttaatattgactgaaaggaggttgagagatgaaaaaccaaccaaatcaaaatttagttaaattaagcgagaaagacaaaactgagaatggaggagctggagttcttgcaggaatttctggtcttgcaacagcaatttcaaaattaactcctgcaattctcggaattgcttcgatttatcgaacttttaccaccggttcaggtgagataaaagccgatggaaatactgttaaatgagatgattcaaaaatggctaaagcagaaactgaaaaagttggaaaacagccaatttactttatttattagttaagaaaaattactatttttcaggctattatttatatattaactcttgatgttctttttggccatattcaagaatgaaagcttcgattagatcaactgcggctttaatatctgataaactaattagaccataagttgaatggaggtaacgctggggaacagaaatacttactgttggggtcccataacctgaatattgtaatttttcagcatcagttccccctccttgtgaaacataacgataaatcgggatgtttctttccttggcaatcctaaaaagaatttcaactaaccgtgggtccattaaagcgcctccatcggcaatatcaattgccactcctgcacctagtttttgaacaccaggaattgcgccttcagtatcatgggatgctcctgtatcgattgcaaaagcaacatcagcattaatcatttttgcaaccatttttgccccacgggaaccaacttcttcttggacagttcctactaaaatcggattagattttaattccttattatataatcgatgtgctaattcatcaatgacaaccacgcctgcgcggttgtcaattgcttttgatgcaaaaaaatcttgattttgcatcaaaaaactaggattattaaaataaattcgattaccaatttcaacacctaaatcctgagcttcttttttagatctaaaaccaaaatcaaaaaaaagatcctttactagtaaggctttttcaattttagatctctccataatatgaattgaagtatgcccagcaaccccaaaaaactcctgacctgatgaactaattaacttaaatcttgcccctattaccgcatttcctcaaattccgccaattgatttaaccttgataaaacctttttcagtaatatctaaaacgataaaaccaacttcatccatatgcgcggcaatgactactttaggtccagaatttggattttttttctgcataattaaggaaccaaaaccatcacgagaatagacaagatcaagtttttctgttgatctttttaattcagcaacaacttcatcctcataacgcgacataccatcaatgtcgcaatattttttcattttttctaatattgacatttaaaaaatcctttcttttatgatataatttagaaaattatacacttttttttataaattccaattaatttctaatcgttttttttcttttaaaaaatcgttaattttgcggaaaaccatagaatttttaagcgatttggcgaaactaaaaggcgaaggatgtgaataggcaaaaactttttgcttttcaaggttaatatttttaactgctaattttgcttttttacccaataataaaaaaacaatatcaactttattttttacaataaagttgattaagttagaactaaaaacctcccatccaatatttttatgtgaattgggactggattttcgcacggttaaaacgtgattaagtaataaaacgccttgttttgcccagttttcaagattcccgttttcttttgaaaagtttgggtaggcattttttatctccaaaaataaatttcgaagtgaagggggcaaaatttttgttcttgttgaaaaagcaagtccatcggcttgaccttttttatgataaggatcctggccaataataacaatttttagagttgcaaaatttgttaattcaattgcgcgaaataaagcttttttatttggaaaaacttgatatttttcatattcttcatcgagtttttccattaatttttgaaaatatgcttttttagactcattataaaaaaagctttcaaacttagttttgattccattttcaaaaattatagcaagaaaaaaatttttttattgctttttttagagaaaatgctataattttagcgtttattcaaaccatctcataccaaaaaggtttaaatctgaaaattcagtacctttaggaaaaaaatcataaggagaagcttatgtttgcaattattaaaaccggtggtagacaacttaaagttgaaaaagatcaaacaatttttgtcgaaaaaatcgacaaaaacgagggagaaactataacttttactgatattttatttattaatggtaaaattggtactccttatgttgaaaatgccagtgttactggtattattgaaaaacaaggaaaagcaaaaaaaattgttgtctaccgccataatccaaaatctacccataaaagaaaattagggcaccgccaactatttacaaaagtaaaaatcacggaattgaaaggataatttaaaaaatggcaaagaccaaagcaggtggttcgaccaaaaatggccgtgattcggctgggcgaagattgggacaaaaaattggtgatggccaatttgctcttacaggttcaatcatttatcgccaaagaggaacgagaatttatccaggtaaaaatgttggaattggcaatgatgatagtttatttgcccttgttgatggaattgttaaattccaaaaaataagaaaacgcaaatacgcaacagtagtaatggctaaataattattgtctaaaaaattattttaaaagaagacacttttgtgtctttttttaattgtttaaaaatcagaaaaatactataaatcaaggaataatttagttaggtagtttaatttttaagtctaaaagcaaataaataattataattaataaaaattttaaattattttaaaataagaaaatttggtttttaaaaccaagtttttaattttcaaaaatttaaaaacttagaagttgctttataaaaaaacacttgtttttatagtgttttttttataaagtcactaaaaatttgattaaaatattcaggattttcgctataaattaaatgccctgttttaggaattatctctgtttgaacctttggaattagtgactcaaaatatgtttttgtctcttgctgtaatacaattccatctctttgacctaaaactaaaagtgttgggatttttattgattttagggcttgctcaatttggtccatcatattattttttagcagattttgtgctaatgaaacaatattaaaattattaaaatactcgtaattatagagactttttgctcattttaaatatttaggatctttatatttttctttgtcatattcataaattggcataaattcaagcatttcttctggtgtttttggaaaaaatttttcataaaaaaaatcttttaggggtaagtttgccttattcattggtgcaataaaaacaatttttactatcattttagggattcttttataaattaatgctgcaattgctgctcccatcgaatgtccgactaaaataacctcctttaaatttaattttttaataaaactaactgttaaatccgcataatattctaaataaagttggtcttcgctagctggtgttaaattatttccagggagagtaaaactataataatttagtgggatttttttacttattgagtcaattgtgcttgaaaatacgttatgatttgaattaaaaccatgacaaaaaacaatatgaattttgctaaagggattcctgttaattacaaaagggtaatttcaattatctaaaatgttattactttgtgaatttatcattgtatttccttgttttttcttaattttttttattttaattatataatattattctaatttttttagcattaaatttttccaaaaaaaattagaaaaaactttggaaaattcaaaaaatatggtataattaatatgccactaaaataataaccttgtaacctggtcaggatagaaatatagcagccatatcgagaagtgttgtgtttagtggtttttatatatatttaataaaaaaataggtaaaaatcactatggcttctcaagaaaataaggcattaaaaaagggctcctgtcattgccctagtcaaaaaaaacacaattttgccagatgcctaaaaaaaaggctaattacacgtgcagaacgtgaaatttttcaatttaatcaagataaaattaaccttaaaaacttttgaaaacgaaaaaccttatcaattacaatgatggctttttcatcaattctttttactttaggtgttgctttttttcttggatttgcaaaaacggtgccaactggcttatcggcaattcccgctttaattacaataattgttaattcacgttacaatgttgatgttagttgatcttttgcggtaatctatttcgcaattaatcttcctttattaatttttacgctagtaaaagtttcaaataaaagcttttcatatcttacttttttttgacttttttttcagattatctgaaatcaagtgttttcacttgatagtccaattcgggatttttttgttaaaaatattctaattaaggaaataaaagattcctgaactttattttattatacaattattggaggaattttatcaggctggtcgattggaattgcctgaaaatttggcggttcaggaggcggaactgattttataacttattttattgctttaaaataccgcaaaccaatcgaaaaaataatgtttagtatttcgatattttttggacttttttcacttgttttactatattttttccaacctgctcaagttaatggccaactttttgggcaaaagttttttgctctttttctctatctaatcgtatcttctacgattgtaggccgaatttatccaaaatatggtaaattacttttacaaatttatacaaacgaacccgaaaaaattattaagcattttaaatcaatcaaatactgacactcctataatatttgagaaggaatatccggctatacaagtcagaagcagtgacgtgtagagacaattatttttacaattgaaaaaaaagcaatcctagaagaagttgctaaatcaaaggtgaatttttgatattcagctacaagaattttacagacaacagatcgttttgatacaactaaaataaattaaattaaattaaaaataatcagttaaaaagctaaatttatcctgaatttaaatataattttattcataagctattaaatttctgaataaaattatataaaaaatcattttttgttaattttgaatgatttttgctattttttaagttataattacaaaagggggcgagattaaccccccttgtaattaaatgttagaattttaagaaatcataaattatatgaaaaaaaattttattttaaacttcgcgacaaaaaacgtaaaagaaaaaaaattaagctttggagttggaataactttatgagctttaatcgtttttgcttatatgatttttgtaatgaattgaggttttgcctctgccggacttaacggtaaagcgggaataagtggttatttaggtcacttttttccaaatgctaatgaagccccaggaaccgttgtaaatcaagcagttaactggggtatcacaattggtcgtggaattggatcagttcttgttggttgattaattgtgaaaatttcgcataaatatacagtaattttgtctttattttttatgctttttggaattattgccccttattcaccaacttatgccgggtttataattcttagaacaatttttgcaattggcggaacaatgcagattattttaattcaaccagttgtctcaaattatttaaatcaaaggcaaaaagctgttatttcacagttttccccttttttttatccaattggaacaataattacgcttattccttttgcaggaattattggtcaagaggctcaggaagcttttcgtgataattgacaaattgtctttttagttatcgggcttcttaccttaattccattaattggatatatcattttaggtactaaatttgatctttatccttcaaatatagaaaaaagaaacaaacaggaaaaactgagtttagctacatttttcaaacaaaaagatacttgatattgaacaattttatatggttcatgacttgtggcagtcgtttttccttttactttttcaaaaccaatttttcatcggttaataggtgatagtgatggaacttttaatgataaaatttctgtttttctaatcttctttctagcaggaatgtttcttggaccttttacaatcggacttttatccaaatatcagctacaaagacgtaaatatatatcaacaattataactcttggcgtatttttttatgtgcttgcaactgttgtttttgttttaaaagttggaaaaaattatgaatatgcaaaatcttatacggatggttgaacttgattgttcttatttttgggcctttttatgggaatttgtctttgaggaattcaaggtgttatgctaaatttacctcatgaatataaaggctcaaacccttaccgtgttggttttcagttcggtctaatttggggtcttggctataccgcttttacaatcgcaacgattattacatcattagttaacacgccaccaggaattgatctaaaaaaattagaactaaataatgtcgatggttatgctcttggagcttatattctcattattattttctcacttgtttcttcaattggtttagcccttttaaaggaaccaaatccagaatataaaaaattattaaaaatacgtagtttttctgaaattgaacgaatcaaaaaataaaaaaaatttcatttttgattcgttttaattaaaaataagaaaaaaattatcattacttgtttttaattaaaaaaaattaaatctatcaatgaaaaaatttaacaaaaaaggagaaatcaaacttatgaaacctattaaaatagctctaattggtgctggaaatgtcggaaattccttcctttatgcagcaatgaatcaaggacttgcatccgagtatggaattattgatattaatcctgattttgccgatggtaatgcttttgattttgaagatgcctcagcttctttgccttttccgattagtgtctcccgttatgaatataaagatctaaaagatgctgattttattgtaattacagcgggaagaccacaaaaaccgggtgaaactcggcttgaattagtagctgataacatccgaattatccgggaaattgcactaaaagtcaaagaaagtggctttagtggaataagtattattgttgctaatcctgttgatataattacaagggcttaccgggatgcatctggattttccgatcaaaaagttatcggtagtggaactgttttagatacagcaaggcttcaatttgcaatcgcaaaaagagcaaaagtatcgcctaattcggttcaggcctacgtgatgggtgaacatggtgattcatcttttgttgcttattcaaatattaaaattgccggtgaatgtttctgtgcttattctaaactaaccggaattgatagctcaaattacgaaaaagaacttgaatatccagtttctcgccgggcttatgaaattattaatcgtaaaagggcaacattttatggaattggtgcagctattgccaaaatagtttctaatattatcaaagatacaaaaaatattatgattgccggagcaaatttacgaggagaatacggatttcacggagtaaatatcggagttccagttgttttaggagcaaacggaattgaaaaaattattgagattagtcttaatgataaagaaaaagaaaaatttgccaaatcagttgcaatcattgataaaatttatcaggatgcaattaaaaatatttaattttttaggaaaaacagtttaaaaatctctctataaatttaatatttttatcctatgattttaaaaaagtactataaatttatagtacttttttaatttttagcaaaaaaattaaagcttaaaaatctttattttttcaaggctaaatttgagcttggaaaaaataaaattaacccttttttaatttttcttatttatataatttaaaaaaaattaaaaaaaggttataaaaattattttggtggctcatatcggactcgaaccgatacgcattgctgcagcaggttttgagtctgccgtgtctaccattccaccaatgagcctttgtgaaaatcaaaaaaaatatcaaatttaacttaaattatattataattataccaatgatggctaaaaaagaaaagaaaacttgaaaaaaatttttatttagaattataccgctactaacagcgccattttttttgactgctataggttgcacgccttttggagcggtcaaaaaaataggtggattagttgccgagattggcgaaaataatccttgagatcaagaactaaatcctaaaaaaccactagattcaattattagtgggcgaattaggtcaagatttgaaaaaattaaggcatctgaatttttaaaacaaataactttcttaaataatgaaaatagtctaaatgaaattaattcacaaattgctaaggaaaaaggtaagcttttaaattcagcaattctttgaagttttattccgggagtcgataattatgaccttaataaaaaatttgatatccaaattaaggctgatcctaattcggtaaatgatgattatggggccattaaaattaaggttgatgctttcgaaaaaggttcagaccggttagttcaaagcaaaaattttctcatttcgggatttaagacagaaataaccggaatttttgcatataaacagcgaattgcaacagcttttcagaatattaataccctaactttaaaagatgaaaaaaattttgatgttaataaacttgattctaatgcagatatttgggattttttaaatctcccatccaattttgaaaaattggatattaacaagttgcgaaattctgatcaatttgatgtacctgaatctgatgtctcagcgcctaatattgccaaaattgccaaaaatccttaccgtttaagggtcaaaaatttctattatctaaaagctaccattctaaaaaattcctatgataaaaacactggtgaaatcgatgtaattttatcaatttatcatgattcttttaataattatgtctcaaaaattgtaaaattaaagaccaaagcaaaccctggatttaataaattaaccgaaaataaaagctttaaattaaaagaaaaatatgcgaattttttaccttcttttcttataaattctcacataaatcagagtcaatcactagctgaatttattaattttggtgattttaactatcaaaattatgatattaaaattgttccttcgcttgcaaatgaccaaaatggtgatttttatattattttaaataaaaaagaaactagtctaacttctggatcaatcagtccgggtcaggtaattaaagttgaaggttttaattcctatgataaaattttttcaagtgaggaatttactagggaaattgactttgactatcttgattcttgatataaattaccaaaaacagccgatcttgctgaaaaactacagagtatttccgaaagtttaaattcttcaagtgattcacttttatgaccgctttttggcaaagcagtagaaaaagcgctttcatcagaggaattatttaaaaacactaataatttgaaaagttttgaaaaatttaactataaatttgcctcattagttgattttaaaattgatgagactggtattagtttctattttggaaattcacttcaggattattatcaagtaaaaattaaatttagccaaaaaactgaaagtaaaaatattatcgctgattttggggcaaaagttcttgaaaaagattcaataaatagctcgcttcgtgcaagatcgcttgtaattcaactccgttcgaatgaatatgatcgccaaacaaaaacaaatacaagcaaaattacatcaggaaccgcttgagtttttgatcgaaaattaaaaaaagacccaaagaatccaggaaaatttctaccaacaaatacttattatttagcgacaaatttacacgttattgctgatttactcaataaacctgaccaagtttattcattttcatacctccttgatggcagccttaaaaatcttgatacaatcagttttgatgatacaaatttattccgtcgttttgatcgtgttgcaaaaactgcaaataaaaaagattatctaggacctgaaggttttcagtatatcactagtgaatcaaagaaattttgggaaaatttaaaaattaatccaatcgggcttaatatgcctgacaaggataaattccgtgattttgcaatcatcgaaattacttttccagaagataaagtcaaaaaaaattcttttaatttcggcatcccttttcttgatcttgatttttttggtcaaccttcatatataaaaaatattcctgatgcagttaaaaattatcaaaaatcgccgcttgattttttagttactgataaattagtgcctaattttacaaaggcaacccaagaaaaaattacagacaaaatcaaaaaagcactacccttacatgcttatttaggtggatttttaggtggatttacttgaattaccgacaacaaaaatgcatttattacaactaatggaattcttaaagaaactgattttcgccaggaggattcaataaaaaaatttcaaggggccaactcaatttcgctccctggtcttcgtggtggtcatggaatgtcgggttcgcttgtagtcaatgaatataatcaagttcttggaattttttggggcggatatttcccgccaactttacctggtcaaaaccagcttgtaaaaggaattggccaatttgatccaattggtctaaaaactgactcaaatccgacaattttagcaaaatgactcgcacagactcaggatatccaaccgatcttgatgcaagacaggaaaaagtttttagccttgaggatccaaaagaactcgaaaaactcgcacattcagcaaggtgaatcaaatttgataatttcatagaaaaagaaaattcaaacatttagttttggcttttaaaaaaacaaaactaaatgttttttaactaattatggaaaaaaaaatgtttaattctctgatgaaaattcatcagaagtatcaggatttaaagcaacttttagaaacagatcagatccttaatgaccaaaaacagtatctacagattgcaaaggagattgctagtattagtgaaattattgaagtttttcaaaaatttcttgatgatcaaaaagttcttgaagatgcaaaaactattttaattcaggaagatgatccagaattaatccagcttgcaaaagtagaaattgcaactatgagcaagaacatcgaagaatatgaaaaaaaattgttaattttaatgctcccaaaagataaaaatgacgaaaaggacgtaattgttgagatccgcggggcggctggcggcgatgaggcaaacatttttgtcggcgatctttttaagatgtatcataaatgagctgattcccaaaaagcaaaagtaaaagttttaagctcctcacttgctttagcaggcgggtttagtcaaattatttttcaaatttcaggtcaaaaaatttactcaaaactaaaatttgaatctggagttcaccgggttcaaagagttcctgcaactgaaacaatggggcgaattcatacctcaactgcaacagttacggttatgccaaaaattgatgaaaaaattgagattgaaattaacccttctgatctaaaaattgatacctatcgatcttcaggagcagggggtcaatcggtaaatacaacggattcagccgtccggataacccatattcccaccggtattgtcgtaacttcacaggatgaaagatcgcaaattgggaataaagagattgcaatgggaattctcaagtccaaaatttataatcttgaactgcaaaaacaacagcaaaaacagtcagattttcgtaaattagcaggttcaggagctcgttctgaaaaaattagaacttataattatccccaagatcgactaacagaccatcgaattaatttttctacctcactaaaaccaataattcaagggagcctaaatccaataattgaagccttacttgcccaagaaaaaacggaactaattctacaaaattatgctaataaataagcgcaaattagaacttttaaaagaaaaacaacgatataatttacctcttaagatctcaaaattggaaaatttaaagttagaactggactatccgatccaaaaaattattggatttattgaaatggaaggcgttaaaattttccttgatcaaaaagtttttatcccgcgttatgaaacccaggaattaattcttaaaataaaaaaagtaataaaaaaaggtgatttggtccttgatttatgttctggatcaggttttatcggtcttgcgcttgctaaatttattaatgcaaaaataactctggcagatataagtgatgaggcaattcttcaggcaaagcttaatgcaaaatataataatttagagctaaatatcataaaatccgacctttttgcgaatattcctgagcaaaaatttaatataatagttgcaaatccaccttatttaaaagaggaaaaactagctaattcagtgcttaattttgaaccaaaaaccgccttgtttgcatggcctgagcctttttcattctatgaaaaaattcttgaaaaaattgataattttttagccgacgatggttgaattttttttgaaattgactataatagtcaagattttttcaagaaaaactaccctgattttataattgaaaaagatataaatgggaaaacaagatttgcttactgacaaaaaacggcaaaaaagtaaagaatttataacattttttaaaaattagtttttaaaaaatttgactttgaaaggaatttaatgaaaataagaactcgctatgctccttcaccgaccggatttttacacattggtggggccagaactgcgctttttaactacctttttgcaaaacatcataacggggattttattttacggatcgaagacagtgataattcacgaaatatcaaagatggagaaaagtcgcagatcgaaaatcttttatgacttgggataattccggatgaaaaaccgggttcagaaacaaaatttgggccttatcgtcagtcagaaaaattagaacgctaccaaaaattagcccaagaacttataaaaaaaggttttgcctactatgcttttgataatcaagaagagcttaaacttcaaaaaaaagaacaaattgcaaaagggatttttagtttccgttatgatcaaaactgactaaaaatttcagatcaagaaaaacaaaaacgcttaaaaaacaagcattttgtaatccgatttaaggttgataaggccaaaaacttttgctgaaatgacctagttcgcggacaaatttgctttgaaggaagtgcaattagtgactgagtaattataaaatccgatggttttcctacttataattttgctgttgtagttgatgattttgatatggaaataagtcatatttttagaggtgaagaacatatttcaaataccccaaaacaaattggaatatatcaggcttttaattgaaaaactcctaaattcgggcatcttacaataattactgacaaaaatggcaaaaaactgtcaaaacgtgataaaaatttgttccaatttatagaggattacaaaaatcaaggttatcatagcgaggcattttttaattttctagcacttttaggatgaacaagtcctgattcacaagagttttttgaccataaaagtctaattaaggcgtttgattataaaagactttcaaaggcgccttctcattttgatattgaaaaattaaattgattttcaaaatcatatatttctaaaatgccagttgataaaattcttgaaaatttagaactctctgataatcaaatttgaaaccgattttttgttgaaacttttcaaaagagtagtataaaatatgctgacttttacaaaaattttgaattttttcatagaccaaaacaagagatggatgaaaaaatgttagaaatttttgaaaaactcgacaaaaaaccggttaaaatttttgccagcaaaattgattatcaaaattgagattatacaaaaattaatgatttaatcaaagaaattggacaaaaacttgaaattacaggtaaaaatttgcttcttccaatcagacttgcaacaacttttacaaactcaggaccagaattggcaagagcaatttggcttttaggaaaaaagataattgaaaaaagactattaaaatgaaagtaaaatttttttcaggcattaatctagatagtaaaattgaaaaaataattgaatttattagcccaattactgtcacaaaagaaaaaataaataattcggaaatgcttgtctatgaaactttaaaccccgaaaataacactatgataaggcttgaaattttagatgaaaatttaactgtattttccggggaaaatactttattttttgaactaaataaggaagtggacaatgttttttttaataatggaaccgaagtgatggttagtacttttttgaaaaaatttgagcatagctcaaatttaattttgcttgaatatgatttttttctaaaaggaaataataataataataataataataataataataaaattgccacttatataacaaatatggaactaataaatgattaatattgttttatttcaacccgaaattggccctaataccggcaatataattcgttcttgttttgttgctggactaaaactgcatattattatgccgattgcctttgatttagagccaaaacacttaaaaagaccggctgcgggaattttattatctgagattgagcatgagatacataaaaattggcaaaatttttctgaaaaatacggtcaaaaaaatctattttttattacccgttatggccaaaaattgtacactgaagttgatttttacactgaaatcgaaacaaaaaaagatattttttttgtttttggccgtgaatctaccggcattccaattgaaattttgaaaaaaaacaaagaaaaatgcctcagaataccaatgatcgcgaaagctcgttcattaaatttagcaaacacagttgtaattatagcatatgaattccacagacaattaaatttcaaaaaattatcacgattcgaggtacaaaaaggaacaaattatcttgatgaaaattaaaaaaattacttcttataataacccaattataaaagaaataggtaaattaaaattaaaaaaataccgtaatttatgaaataaatttgtagtagaaggtgaaaaagatattgaatcagctatcaatgcaggtttagttttgagaattcttacaacaaaaaataatgttgaaaagtaccaaaaagttaatgttgatgtggtaatagtttctcaaaaaattcttgaaaaattatcccagcacaaaagtccatcagaagtaatcgcagtttgtaaatcaaaaaaacaacgtaaaataaaggattttttagactcaaaacgacttgtaattcttgaaaatattcaaaatccgggaaatttaggaacaattattcgaaattgttatagcttcggttttgaccttgtttattcaggtgttgatctttataatgttaaaacaatttctgcctctaaaggcgcgatttttatggcaaatatttactttttaaaaaatatttcagatttttttaaatttgggccaaaacaagaaattattatcagctcacttgaaaaagatgctcaaaatcttatggattttaaagtaattccagaaaaatcatatacaataatttttggaaatgaaggtaaaggagtctcaaaaaaactaaataaactagcggataaaaaaatttatatacccataaattttgaatcattaaatattgcgagcgcgaatgcaattttttgccatttttttcaattaaaaaaataaaaaaaatggcagaggtgacaggagtcgaacccgcaacatacggggttgaagcccgttgttctaccattgaactacacctctaaaccaaaaattaattataccacattttttaaaaaataatataaaatttaactaaattatgaatttaaattcaactaaaacatcaaaaattaaagatttttttatttttttatgatttattattaaaatttcactaatttcttttggcggcggaaatgcgttaatgccaatcatttacaaccaagttgttacaaaaaaacaatggatttcaaagtctgattttgatcaaggactaattttgacaaatttactacctgggccttcggttgtgcaaatgatttcgctaattgcaattaagagattaggaagttttttgggggttattgttacaattttgggaattttaccccatattttcctgtttttattgcttatttatgtaacaaaatttctcccagaaagatattttattatttttaatttggctgttttttctacaattattggtgttttattaggtttttcatatatttattggaaaaatgataaaaaaaatttaaattcggctgtttattttagtatcttaattgctagttttgcctattgcttttttgtgccaaacccttataatctagcgcttgtacctcttttttgtgttatttttatttattttatctgatttttaatcaaaaaatggaagagaaaaaatgatactaataattagtttggcaataatcgggcttgttttaattagtctactagtttttggcggcggtcaagtttttatgcctgtttttagctggttttgagaacaactagctcacctgggtctaaaaattgatcaggaacaaattagtcaaatttttactattgctaattcaactccgggggttatctcacttaaattagcaggaattacgggctttttaattggcgattatggtgttttgggttgatttttagccattttttttataattatttttattttgccggctatttttttaataattttttgattgagaattagcaaaaaaatagctatcaaaaacaatgttttttgaataaatttgataaaaatttttcggccggtgattgtcggaataatattagcacttgctttccaattacttaccaatttgatttttataaattatagttttaattcaagtaaaggttattttttaacaaaaaaaagcagtgaatttttagagggttgaagattttgggtttttattttttttgggacctcatgggctataattgtttttatttcttacttaaagaaaaaaaacatatttttactaataattttaggaattattttggccctaacttgccttcaaccttgaatttaaaggagctttatggattctacaagaaaattttatcataaaaaagactattttattgactatgaaaatcaggttttaattcttgaaaaatcatttcataaaaaactgttaaataaagaatttgcttttaaaactggttttaaaaaaattggtgggactttaattggtgaagttctcggacttgatagttttagctcaccttttcgggcgtttattaaaatcgcaaaactagatatgccgattttggatagaaaatatattgatgctggaattgcaattgaaccactcgtaattaaagcgctttctgataaattaaggcttgaaattgaaactttcccacccgaaaaatttaattatgactattttaaagaagattcaataattggcggaattcccgatggatttattccaaaaactaatacaataattgaaattaaaacaactggtattaaaaatttagaaaaatgaggccaaaaaggggaaaatttaccccaaaaatacataaaacaagcacaattatactcttttttaaaaaaagcaaataaatttgtaattgtggccacctttcttaaggactcagactatgaaaatcctagtaattttcctattaaaaaacggcatatcaaagcttatagttttaatgtcaatagtcaacaagttcttgatgatatcaaaaaaatcaaagaatgatataattattatacaaaattaggaacctcacctaaattttgcttagttaatgatgcccaaattcttgaatatttagcctgcgagaatgaggatcaatggaaaactcttctggaaaaatggcttaaatcaaattaggaaaattttttaataatgaaatcacagtcaaaaatttatctatataaaaatgttttaataattgtctctgaaatgagccaaattataaatgaagcaattaaaattcatcaacttgataatattaacagtctagttttggcaagtgcaattaatgtttttgggccgctttcatacctaattaaagaagaaaaaggcggattttcaattaaaatattctctaaaaacttagaatcattagtgatcgaaactaacaaaaatggccaaattcgggcaagttttaacaataaaaactacaaaataccagatgaatattttaaaaaatacaaccctaacgagttagtaggttcatttgtcgggaattctggttttttaaaaattaataaatttggtcaaaaaaatgattattcaggacaagtgccattacaagttggtgattttgtcagtgatttagctttttatttttatcaatcacaacaaacaagatcagcgataaaaaatttaattgaaattgatcaaaatttaaaaatcactaaagcacaatcattaattattcaacttttacctaattattcagagagcgaaattcaagaggttgaaagctgactaaaaaacaaaaagatcaaagattttatagagttttttgaaaattttgaattaattggaagtaaaaattgaacttattattgtggctgtgataataaaaatttaattgaaaatttaaatttatttactgagaaggaagttgatgatttaattaaaaattaccaaaaaattgagtttgtctgtaatttttgcacaaaaactcaaagttttaccaaaaaagattgagtttttgccaaaaatccatttagccttgcaactgttgaatccttaactggaggcgcacttgcagctgaaattgttaaaacaaagggagcaagcaaattttttgccggtggaattgtttgttatcaaaataaaattaaggaaaaaatcggaattaagacagaaaatggagttactaatgcaaaaacagcgctaaaaatggctgaatttggtcaaaattttttccagactaaatacgtaatcagtctaacaggaaatgcaggcccagaaattcaagatggaaaattaggccaagtttttattgctctcaatgaaaaggtatgagagcttaatcttgaaggtgatcgtttgaagataattaatgattgtattaaatttgcagcggaaaaaataaatgaaattagaccaaatactattaaaatttaaagatttatattataatatatttacattatactaaattaagcaaaaaataatgataaaatataagtatttttattattttttttaatttgaattaaatttacttaatttagattataattatacttatttttatttttttacttagattttgaaaattaacaaggttaaccaaattaaattgaggacgaatttttaatgataaaacgtgaatttttacctgaaagtgctgagctaaaaataaagttaactgcagattctaaaaaatgagctgaattctaccaaaaagctgaacaaaaacaggcagcaaaagtttctttacgaggttttcgcaaaggaaaagttcctctagaaaaagcaagagcttatttaaatccgcaagctgtttttgagcttgccctcagaatgtttcttcccgaacttgaaaaacaggcggcaacaaacataattgatagtgacaatgttattgaatcaccaatttttaacatagttaatatggataaaaataatttagaaattgaatttctttatccggtttacccagaaattaaattgcctgattataagaaccttaaaaccaaatttgccattaaaaaaataacaaaagaagatatcgagctgcaaaaacaaaaacttttggaagcaaaaggaaggtttatcgaagtaaatagacctgtaaaaataggagatgttattaactttaactttaaaggttttattgatgatgagccttttgatggcggtgaaggagaaaactttgaccttcgaataggttctaatagttttattgccggatttgaggaacaacttgttggtcttgaaatcaaaaaagaggccgatatttatgtaacatttccagaaaattaccaggttcatacctatgcaaataaaaaagcacgttttcgcgtaaggattaataaaataaaggaaaatcagccagcaaaattaacaaatgaatttgttgcatcactaaaaattcaaaatgttgaaacaattagtcagttagaagtttatctagaaaatcttacagagcgcgaaaatatcgaaagagcaaaaattgatttccaaagaaatgcacttactgaaattggagaacaggttgaggttcccttggctaaaaaattaattaacttagaaattgagcgacttaatgaagttttccattcaacactcaaacaacaagagattccacttaaagaatatttgaaaatcactaaatttactgaaaaagatatatacgaccaattcgaagtagaagcaaaaaaattgctaaaaaattctttcattttcgccgaaattgcaaaattagaaggacttgtgccaactcagcaagaatatgaaagccatgttgaaaagttagcaaaatttactggaaaatcagttcaggaaataagcgaaactgtttcttataacgaaattcagattaatatcactaatcaaaaagtaattgataaattaatcgagttcaatcatgaggcaaaagatgaggaaatagttaataaaaaccaaaatgataacgaaattgaacaggataaagaacaaaaggacaacaatgaagaaaaaataaagcaagaaaataacttagaaaacaaataaaaaattaaaattgttcttctaaactttattttttacaaatttttaaaaattaataaaatcataaaaggaggaatatgtcacgatttacgcgttttttttcaacagttttagcggttataatcggaaatgttcttttatttgggataataatcgctactttatattttttatttaaaaaacaaatagaaaattttaaatttgataaaatcacaaaaacaattaatgaaatccaggaagcagttgggaaattagattcagcccaaataaacaaatttcaggaagggcttaataaatttacgagtttggattttgatgccttgaaaaaccaattcgaatcagtaaaaacaataccttctaaattagaccaaattctaaaacaattacaagaaatttctgaatcactgaaaaaagtacaaaatggctctgtatctcaagctgctcatgcgcttgtaaatacaagtatttttgaatttattaatcgagttaaatttttataaattttaaaaataacagttttacaaacccaatttatggaaaaatttataaattgggtttttttattaattaaaaaattaattaattaattaattaattttttaatttttaattttgttggtttttcagctaaaaaagttccgactacaataacgtcagccccagaatcaaaaaccttttttgaattaaaatccttaatgccaccatcaacttgaatgataattttataattattttcttgaattattttggataattcttctatttttttataagtattttcgataaaagcctgaccgcctttgccaggttcaactgacattattagaactagctgaatttcgggtaataaatcataaatttgttctatttttgtctcaggttttattgctattcctattttaatttttcgcgaatattttgatattatctctttaatttgagcataatttctactttcaaaatgaattgttgcaaaattcacataccctagtaattgcttaatttgctcttcgggattaacagacattaaatgaacatcagagataaattcttttgattttttaataatatttttgatttctggaatagatattgctacattcttaacaaatataccatccataaaatcaaagtgaaatcattttatgccaagattcaaaaaaattcttgttgattttagccgactagatttttttatattcaaaagcgaggggctaataatttttcttttcatattttcctaaaaaataaagataatttttataacgattttctggtatttttccatcttttagcgcccttttaatgccgcattgatcagttttctcctgaaaatgaaagcaggaacggaatttgcagtctgatgaaaattttttaaatattttaaaagcattgcgaatttcatttttggatatctcgctgtatgaaaacgaggaaaaaccggggctatcaattatccgaaaattttccttttcaataatttggacgactctagttgtatgctttccacggtttagtgtctgggaaatctcttgaatagcaaattttttatctaaaaaattattaataaaactggtttttccgacaccggtttgaccgataacaaagttaagttttttttctaattcggcttttaattctacaggaatttcattttttttattattaataaaaaaaatgttataattcattttttgataatcaagtaataaattttcaaaattagaatcaagatcaattttagtaactaataaaattacaggaatattttttgcttcaattaccaataaaaatttatctaataataagcttgaaaaattaggttctctaatcgaaataaaaactaaagcttgatcaatgttggctacttttggacgaattagctgattttttctttcataaatttttttaataaagcctttttcttcaaaatcaacaaagtcaccaactattggcgatgtttcattcaaccgaagaaggccagaacctcttaaaagcgggtataattttcggtttttaggatcgacaacatcataaaaaccggcaataattcgaacaacttgccctttcatctaagttttttggatctctttacttataattttttctatttgggcaacacattcttctaaattgtcattaaccacttgaaatttgaacaaatttttaattttaatctcagctttggctttttctagtcgttgatttatttgaatatttgtttctgttagacgtttttgaatccggtttttaagagattcaatggaaggagggaggataaaaatagttaaaagttgggataattcacctttatttttgtaattttcaataatatttttagcacctgttgtatcaatttccaataatgggataaaattttgagactgaataaacttaatctgcgattttagggtcccataataattattaaaatgacaacttcattcaataaattcatcattttcaattttttctttaaactcttgaactgttaggaaaaaataattaactccgttaatttcgtctctccttttttctcgagttgttgcagaaattgctaactttattaataaatttttattttttaataaaagtgattcaattgtgcccttgccaacccctgaaggtccagacaaaattattaatttactcatttttaccttcattgtaatattttaggaaaaaaacgctgtttttaccgtatttttttatttgatggattgaaaaaatgtccggaattagtttagagcctaaatttgttttataaattataagtccattttttgctaataaattattttctgcaatttttcagaaacatttttttgtaatttcttcttcactatggggaggatctaggaaaatgaagtcaaattttttatttttaagatcattaattaaaaaaattgcacttttattaaaaatttgataatttttaatattatattttttacaaaaatctactatattttggtaagctttttggtttaattcggttgctaccacctttttagcgccacgagaagtcgcctccagcccaatcgctccagtaccggcaaataaatcaagcaccttagaattaggaatttcaaattgaagttgggaaaaaattgcttcacgacaacgactagacattggacgcaccactgaaaattcaggatttttaataaccgcaccacgataatttccggaaataattctaatcataaatttttaaaaattataccaaaagtttatagaaaaatgtatgaatttttatttaaaaataattttaaaacatcaaacaaagaataaatataataaaaatcaattttttctaaaaataaatctaaactaaaatctgatcaataaataatttctaattcttttggattaaaacgaattaaaggttttaagcttcgatggcgaaaacattccatccccccagcaaaatcaaaattcactaatcgttggttggttttgcaaaccttacaacttgtaagatttgcaattcaaccattaaatttaatccagttaataattgtataaaccttaattgcatcagcatttttggcgttaattttaaaaaatgcttgttctaaaattggaaaaattttaggttcaaaattttgctcatgcataatttgtgaggaaaattttcaaaagttataaatatttttattaactaaatccaaatgcagaaaacattcgcccttttttaattttgataatttattaggattttttgctaaaaaaatctcaaattcacctaaacaaccaagatttagtatataaatatttttgcttgttgtttttctaacgcctaatgctaccatttttataatgccaaaattagtggctaatttaattattagatcaaaatcacgaaaattaagtcgatcaacaataattcctttaataattttttcagccatattctaagaaaaaattcctatatattagtgataaaaaataagtatttaaatttaatttggattttaatattaatttaattaaaaaaatttaaaaaatttttaattaatttttgttaaaaaaataaaatttggtataattatttttggttagtaacaattaaaagttactaaccaattacaaacatttaattatttctctattttactattttttcttatttgtatttggtaaaaattactttattctaattaataacatattttactccaaaatcctagtattttttttattattaactgccttttgttgttactgtaaattttatttacattgtatttgggaaagtagttagggtagatttaataattccattttcatatatttatttccttctaattaaatgaaataaagttagtaacaaaaacaattttagttgctaactttattttatttaattaaaatataaaataaaaatgacttaatacccgaatctttttatcattttagggttattaaatcattttttcgctatagacacgcggttttttagaacaacttttttgccgaaaatctcttcaagttctctacgggcatctgttccgatttttcctaaaaccgaaccacccttaccaattattattggtaaatgtgatttttttcctacataaattgttgcctcaatttttacaaaacggttatctgattcatcaaaattatcaattaaaactgcgctttgatgggggatttcgtcttcaagatttaaaagtatttgttttctaataatttctttggcaaaaaaacgtgaactttgatcagtaacatccaaattactataaaaatgttcggatggataagcaaacttttcaatttctaatagtaaattaatacgtaagtcttctgaatttgttgaaaagggtaaaattttttcaaaattaagttcacgaaaatttttctcctgaattttaaaatttaatttatcattttctaggtcagttttagttatcaaaacaattttattcatatttttagcaattttttttgccaaaaatctagtattttggtcaactggtttatcaaccgggtgcaaaaaaaggaccagatcaattccttcaagtgttgagttaatcgcataatttaaggaattacttaaattattaattcgcatatgaaagccgggagtatcgacaaataaaatttgaagattatccttattataaattgcatttatggcatcgcgggtagtttgtgactttaaacttacaattgagactggaaattccacaagcgaatttataagtgaggacttaccaacattaggtaaaccaacaattgctacaaaacatgttttttttatatccataaattattaaaagaaatccttgttaaactggtttggcaatagttgatttaatgttctttccctaaattctgacttggaattataaagaaaaatactaactttttctgaaaaaaattcagcacaaacttgcaaacactgaccacaagggataatgaatttatctgtatttgggctataaatgtgaatttctttgaaagttttaggttcaatttcgcttgcaattgcctgggttattgcaaccctttcagcgcaaattgttgcgggaaaaacggcattttcaacatttacgcctttaaaaaattggccagaagtagtcactaaaattgcagcaacggcaaaacctgaataaggacagtaggcttttttacttaatttttctagttctaaaaaaatttttttcattatcgattaattcctaaatttattaaaatattttcaactttttcatccattaacttatttgttttttcatcctggtgatcaaagccaagcaaatgatagatgctatgaacaaaaagataagaaaactcacgctcttctgagtggccatattcatttgcttgttttataatttttgctggggtcataaaaatttctcctagaaaatgaaggcgaaaattttttttagcaattattaaattacttggaaaagacaaaacatcagggatataattgatatttttgaatttaatggctaatttttgagcttttctttgagttattaacatcaaatctagactaatttcacctgttatttgctctttttcgactaaaagtttaaaaattttcctaaacaactttaaatatttaaacttaattctgctttgattaaggaaattaatttttgccttcatttaatataattttacaattattttataaaaagatcaaaaaaatttccattatccttaagaaaaagtactgccggtatttgtgttttcggtttaagtaagagtgattttgtaaattcaataataaattcattttgttttgtattagttatttttataagttcaagtctaatactgcggtcctgaaattggaattgagcaaaggaatctttatttaacaaataataaatatcagaatttatttttgcaaaagttttgtgtttttcatcaatttcaagtataaaattaattgttttatatgtttttatttggaaaaaataataaagactaatcgacattaaaattaataaaattatactaattaataatgaaattttactgttttgatatatttttgatatcaagtatttctccttcctcgtttataaatctttttgagtgggaaatttcgataaaaaaagcatttttttgataatttgtaataactttttttaaaaattcaaaatttttttcatcaatattttcaaaagcctcatcaagtaaaattaagtcaaaatcttgtgttaataattgcaaaagtgcgattatttgcttttgcccacttgaaaaatttgagccattattaacaaattttgcatcaagtgaaatttgtcattcataaagcatttcctgaatatcaaaacgctgaaaattatttattaaattctgaattttttcaggattttcgtttgtaataaaagaaagaaccgaaatacttggaaagtaattatgggattttatataacaaattcttttgcgaagttcgttttggtcataatactttagatcaagattattaattaaaaactcgccattatagacaatatcttgatttaaaagtcttaaaaaagtggatttcccacttccatttttcccaattattcgtaaattcccgttaatccgcattttatcaatataaaaaagtgtcttgtttttatagtaactaacgcttaaatcttttaatttaatatcagaaattttttggtggtatttaccttttgcttccttgtcaatatttaaaacaaaatttaatagttctaattctcttaaaaatatcggtaaatttgtaactatatcgacaaaagatgagagtggattgataaaaaaactaaaaaaacttaaaaaaagcaaaagttctccaatcgataattttttatcaaaaattcaaaatgaagacactaaaacaattaggattggcgaaattgaaaaaataaaattattaaaacttgacaaataattttctttttttcaaatgttaaattcagtatttttataacggtagtatttttcatcaaattgacgctttaaatttttataaacatcatcccgctttaaattttcaattgaaaaaattaaatcattagtgcttgtaagactatttaattgatcttccattaaaaatcgatggttttttgtgatattttttctaacaaatatactaactaaaagataaactatactgatagcaataattagcccaaaaatttttacatcaattcaaataagaataaaaaatgaaattaaaaaagtgattaattcattaaaaatatggtaataaaagctagcagaaaaactagcaaaactaggaattaaatttattcgtcgaatataatcatgattatctaattttaaaagttgaaaattttcccctgtttttaaggcgctaaaaaatcgatcaaaaatttccttttcaattttaagttcaattttatgaatataagtttttttaaaaatatcttgtaaaatccgccaaaaagcaatccagataaaaaaaatacaaactttgaccaaaagcgaaaattcagtctgcgggaaaactttatcaataacagttttcataaataatgaggagacaaaattactaaccgcagtaataaaaaataaaaaaagtaaataccaattactttttgcctcaaggaaaaaccaccaattatttcagcttttatcttttttttttgattttttataatcaaaatctttttgggcaaaaatcacgacgttttggaaaattttctgcatttcagttttagtaattttcatttttccttttaaagggtcgataatttcaaatttcctttttgtaatttttgttagtaaaacataatgatttagatcgcctgttttaattaaaataattgttggttttccgagttctagttcttgtagattttcaaatgatccgccatatgattcaagaataatgccaaaatccttggcaacacgttcaagatttgcaatatttatgccatcatgtgaataaaatgcctttgtttttaggtcatttattgagatttttttatcataaaaatgataataaattgattggagaaccgcaagtccgcaatcccttaagtctttttgcaaaaataatttcattctctgttggaaattatgataaaaatagtaaaattataaaaaaaagtgaaaaaaataggaaaaacaaaagtaaaattatgaaaaactataaatttaaaagaatttttttaattgtaactgactcgcttggaattggtgatgatggtttccaaaaaaaatttaatgatcaaggcgcaaacactttatattctgtctctaaaactggggaactaaaaattcctttttgaaaaaaaatggggataggaaatatcgccaaaattgaaaattttggcaaaaaaaataaacaaccacttgcttatgtctcaaaaataatcgtaaaatccaaagcaaaagatactcttgctggccatcttgaaatgatgggaatcgaaactgttaagcctagcccaaattttgatgatggatttccagatgaattaattaatgaactccaaaaagcctttgataatcgtcagattattggtaataaatcaattagtggaactgttattcttgcagaattagggcaaaaagcaattgatgaaaataaaataattgtttatacctcaccagattcgactttacaaatttgtggacatgaggaaaaattagggcttgaaaatctttatcggtatgcaaaagcggcccgaaaaatttgtagctctcggccagaatgaaatgttgctcgtgtaattgcaagaccttatataggtgaaaacggaaattttaaacgcaccttcaaccggcatgattatgcaaatattccgccgaaatcaattcttgattccttacagaaaaacggaattgaaactattggaattggaaaaattggggatattttctcaaatcaaggtctagataaaatttttgggcctaatagtgatgaaaataatatggatatcgcaattgatattgcaagtcaagaaagtgaaaatcaattcatttttgttaatttagttgaatttgactcaagttatggccaccgtcgcgatgttatgggatattgtcaaaatttaaacaattttgatattaaattagctaaactaacaaatgccctaaaagatgatgatttactaataatttcatctgatcatggaaatgatccttgttttcccgggacaaatcacacccgcgaggcgctaccgcttacaattttttcaaaaaaatttaaatcaaaaactaaagaattaaaaaatccaatttcttcactggccacaatcggcaatttaattgcaaaaaattttggaattgaaatggctgaaattggcgaagatatttttgatttcctagactaaatttttaaattttaactaataaaattgaaaaattatgttaaaatagtttaatctattgaatgaagtttttcaatttgttttgtaaaaattcaaaagaagtaaaattataaacatctaaatttattatttaatttgatcaaaattaactaaatagagcggactgagatgaaggaatcggagataaagtattttagcaacaaaaaaaatcaacacaaaaataaagtcaaaaatagtgaaaaaatagtaaatttgtctaaaaaattaaaggttaattttaatgttgaaaaaaatttaaaaaataatgtctctaattttaaggaaaaaaaattaaaaagcaaaaataaaaaaaatattagtcaagtaagaaaagaaaatgaaattagtgtaaaaactgaaaaaaaaactaaaattttagctaaaaataatcaaaaaccgaaaaatgctattgaaaaattagataatgaaaattttaaagctaaagctatagaaaataataaaaaaatagaatttcgaaacttaactaaacgacgtttaggacgaatgggggttatttctgtaatttatatttgacaactttttgacaaaaatatcgatattaaagagataaaaacaaaatattttgaactaacaattgaccaattaaagttgcttaattttataaaaaaaaattatagttttttaagaaaagttattaatttacagttaaaatccaactgaaattgagaaagaattttgccattaattaggtcaattttactagtaggtgccgcggagttattttttgtgcctagtcgaattgtttttaatgaggcagttgagataactaaaatttttagcattgctggtgacaatgaattttgctttgtaaatgctgttttacaaaaaatatacaattattatgaaatcaaaaatctttttagaaattaaaaataagtccgaaattaagcgttttattaaaaatgaaatgaaatttagaaattatcgtcgaattttaggtaaaaaattcaaatttttattttataatttatcaaaaattcttgaagttgaaatttcaaattataaatctgcgattcttgatctagaactaattaaaaatattaataaaattagtaattggattttttgtatgagtaaatttttaaatgaaaatttaattataaattttcgtatttataaaaatttagcaatttttttatattatagttgaaaaatacaccttaaaaaatttaaactgcatacaaaattaacaaattacgaagacaagcgccgggacgcttttaatgccttatcaattgaatgaattaaagttgattcggtgtttaatcttaaaattattgcgattttaaagaggtgaaaataaatgaccctactcgaaaaggttttaaaaatgggctttgaaaaggcagaatcactaattcgtacaggttatgtaaagctcaataatcaaacttgttattttccaggtcaaaaaatttcaaatttagattccattaatattaaagaaaaacaaaaatatgtctctcggggcgccttaaaattacaagccgcatatgattatttcaaacttaattttcaagataaaattatccttgatattggcgcttctaaagggggttttactcaattttgtcttgaaaaaggagctaaaaaagtttatgcactagattcagggactaaccaacttgattattcactgcgaattaaccctaaagtttgtgtaaaagaaaagacaaatatcaaatttgttgataaaagtttttttaatgatgaaattgatctaatagtttgtgatgtttcgtttattagtcttaaaaaagttttagtggtagttaaaaatttgttaacacaaggtaaaaattgtatcacacttttaaaaccgcaattcgaagcaaattcaaaatatgtccaaaagggtggaattgttccaaaactataccataaatttttaattaatagaattattgaatttgcaaaaccaagttttgaatttctcaatttttttgaatcaccaattaaaggacaaaaatccaaaaatacagagtattttttacattttattagaaagaatgactaactttaaaaataattttccttttcttaacaaggttacttaccttgattctgcagcaatgatgcaaaaaccactttctgtaattaaaaaaattagtgacttttacttaaattcagctataaatattcattcacagaattcaaaaataggctatgaaaatagtgataaaatcggaaaaattagggaaaaaattgccagatttatcaatgccgaatcagaagaaattatttttaattctggaacaaccgaagcaattaacttatttgctaatatgattaaaaaattcctaaaaaagggtgatcagattttactttcgcctctaaatcattcatcaaatttaataatttgaataaaaatagcagctaaaataggtgccgaaattatttatagtaaaaaaataattgataaaatttcaccaaaaactaaaattattgctttttcacaaacgaataattcaattttagttaatctgaatttggtggagatttggaaaaaggctctaaaataccacgcttttgtatttaatgatgctactcaggcaataaattatcaaaaagttagtctgaaattatgccatggccttgctttcagttcaaataaattttatgggccaaccggccttggagtcttagcaataaaaaaggaacttcttaataaattagagccagttaaatttggaggaggaacagttgcagaaataaattctaaaaatatagtttattataatggttatcgaaaatttgaggcaggaaccttgaatttagcagcaatttgggggcttggtgctgcagttgattttataaatgctatcggaattaaaaaaattgccaaaaaactacaagttttaagtatttatttatacgaaaaacttgaaaaaattgaaaaaattgaaattttttctaaaaaaggcaatcatattataatttttaatattaaagaatttaacgcatcggatgttgtctcatatctaggaaataataatatttatgttcgcagtgggacgttttgcgttccttttttagaaaaaatactaaagaaaagaagctttattcgtgtttcactagcattttacaatgattttaacgatattgatagactaatttcggttttagaaaaaaaggagtttttgaattttgtataaggatttcagcaaaaggcgtgatattattttaagttcaaataaaaaatttaatgaaaaaaaacgaatttgtctaacaaaaaatagtcaaataaatgaaaattgtgatgatagggcaagtcttgatttagaaatttttgagaaaaaaattgaaaaaattcaattttgcgcttcaggatgcagccttttgattgcaagttgttatttatttgagaaaattctaattaaaaaaactataaatcaagtcaaaattttactagataaatatgaaaaaatgataaattttcaggaaattattcctgaattagacagtcttaatgctttagttatggtaaaaaatcacccaaatcgcctagtatgtgtgaatataccagtaaaattattaaaaaatcaactaggaaattatgaaaaaaatcagaattaacaaatttttatcggaaatgggggtttgctcgcgtaggcaatctgagaaattaattttacaaggtcggataaaaataaataacgaaactgcgaaaattggacaaataattagtcaaaatgatgtaattgaacttgatcagcaaaaaattactaaaaaaccaccaattttttgatatgcattaaataagccaaaaaattacattacaagccggtttgatccagaaaatagaccaacaataatggaattttttagtaaaaatgaatatctttttcctgttggaagattagatttccaaactaccgggttaattttgatcacaaatgatggaaaaactacaaataaattattacatccaagctcaaaaatcgagagaacatatttagtaaaaacagattttagtctcagtgataaagaaattcgcttcttaaatgataataaaatccaacttgatagtgttaaatccatccaaaaaattaaaaaatgtagctccagaacttaccttgtaacagtttggcaaggttctaaccatcatatcaaaaaactatttttgtcaataagtaaaaaagttctaaagctgaagagggtaagttttgcaaatattaaactagataacatcagcgaaggcaagtaccgaaaactaacaaatcaagaaattaaatcactcgagaatcaagtaaaaaatacgactagattaggtgactaaaaaattaaaaatttacatcaatttacgtattctttttgatttttatattaaattttttgatataaaaatcaaaaagaataggaaaatttgcctcgcaaccctaaaggttttttttctttaattcttaaaataaaaattattatataaaattaaaaaaacacttgtttttaaagtgttttttttactttataagcactaaaagaattatctagactagttcaattattgccatttttgaattatcacctaatcgacttggaattctaacaatccgagtatatcccccgtttctttcttgataacgaggtgcgactttgttaaataaataaggcataactttaactccatctctggtttttaggccataaaggaagctaagaatttgccgacgggcggcaagatcgtttttttttgcctttgtaattagtttttcaactaccgaacgaagtcgttttgcgcgatcaagggttgttttaatatgtccatgtaaaattaaagaggttgcaagtgaacgaaaaacttggcgatctcaggccgcatcatgccgataaatttgatgtggatttgccatttttaattttctcctttattttcgtttttatagttttgtagtttttccattatctcttgcaccgattttcgtccaagatttttaatattctcaaaatcatcttgactaagtttttcaatatctgaaattttataatactgcgcgcgacgaagggcattaagtgaacgcacagaaagatcaagtgcatcaatactatttgaaaaacggcggataggttcttctttaatctcttgatcaccaaagaaatcagcactgaatttattaaggttttcaacatcggcaagcaaattaaggtgggcaataagaatttttgccccctgcgaaagagcatcttttgcaaaaatagatccatcagttttaattgaaaaatttagtttttcttcaattattggacttgctgagttaatttcaacagcttgataatttgcatttaatacaggcgaaaaatcactatcaacggctaaaacagacccttcaatttgggactcaagcagcgaaattacctcatttacatactttttgtttgtttcaaaatctacaaatcctttaccatttgtaataaaaagttcaaattttaaagctcctactttggaaacatcagcaatatataaatccggatttacaattttaagaccactgtgagattcaatatcacgggcataaatttgccctgctttttgacctaaaaaacttgccacgtggattgaattttgactaaaaacacttggattatagaaaaaacgtactctttttaaattattaagaattgtgacaacatcttcaattacatcatcaagaacggtaaattcatgttttattccctcaattttaaccccaaaaactgcacaggaaggaattgacgataaaactgttcggcgaagcgcatttcctaaggtattaccgagtccgcgttcgagtggttttatttcaaagcttgtttcaaattcattaacttgttcaacaagattttcagaataataaacttttgcgtgttttttcataagtttttaccttttttcctggcgtttaaatcattttcgaggtgggcgtgttccattatgtggaactggagttacatcttttgttaataaaatgttaagtccggaggtaataatttgttttcgggccgcttctttgccctgtcctgtcccttttagttcgacaatcacctcccgaattccatgttcgcgcgctttttgagccgctgcagcagttgctaaagttgctgcataggctgtcttcttctttgttcctttaaatccaactgatcctgaagatgcccaagaaattacatttccttgtttatcagtaaaagaaataatagtattttggtgcgaagaatgaatatgagcgatgccgacggtaacattttttggacgaagttttttaactttttttacattagttgccatttttatttacctttatcctttttagccataattgtttttcgcggtcctttacgagttcgggcatttttttgggtaacttgaccacgaacaggtaagccttttcggtggcgaattccacgataacatttaatttcaattaatcttttaatatttgactgaacctcgcggtgaagatcaccttcggtcttataagttttagcaacatcacggatgacttgtaaaacttcttcatttatttcttttaccttggtgttttcggttaaaattgggaatttttttccaaatttttcttcctgtaactttgccgttttttcaacaatttctgttgccagcgatttaccaattccaaaaatgctacaaagagcaatcacaatccttttatgatttggaatttcaacatttaaaacacgtgccattttgaatatttagttaaatatttctcctttttttagatttttgtaaaaaatgaaattttttttaaaaatcaaaattttttagtttttttaaataaaaaaatttttgatttctatttgaaaaagattaaaactataaaaatctagcctaaccttgtctttgcttatgcttttttattaaacaaataacacgattaattgagcgtcgtttaataattttacaatctttgcaaatttttttaatacttgcacgaactttcatatttttatcctttaaaatttatttaaacaatttagttatataaattatttaaaccggtaaactattcttccttttgataagtcataaggcgaaatttccacctttaccatatcaccaataataatttttatatgatgaattttcatttttcccgcgatatgacagtttaatttaatcccattttcgagagttacctcatattcctgggcattaaaaacgtgggtgacttttccctgaaataatagtttttgttcttttggtaaatttgccatctagttttgagccatttctgtaagaattatccctctaccatccttaattaaaattgtctcttcataatgggaggtttttctgccatcttttgcttttaccgaccatccatcctttaaaattttaatatgcggcgaggtttgtagaatcattggttcaatgcagataaccatattatcaactaactctatcccttttttggggatgccgaaattataaatgtttggattttcgtgtaattttttgcctatcccatgaccagaaaattcatagggagtgaaaaatccataggattttattacgttgttaattgcaaaaccgatatcacctgtttttgctccaggttttatcgctttaaaaccggcaaaaaatgcttcttttgcgcagttaattaatttttgattttcttgatctggtccaagtgattttgtaaatgcactatctacaaaaaaaccattataagaaagtcctaaatcgattgaaacaagatcattttctttaatgacatattcactggggattccatggataagaatttcattaacacttgcacaaattgttgccggaaaaccgtgataatttagaaaagctggttttgcatttcggcttttaatctcttcaaaagctatggcatccagttcttttaaagagattcctggtcttacaaagtcataaatttttgccttaacttctgccaagattttgccagcaattttcaactggcttatttcaaattcatttttaattatagccatttttcaatttctataactgtttcttcaagggtttgctcggcatctagataatatattataccactttttttgaaaaattcaacaattggaatcactgaattattgaatttttcaattcgatgtgtgataatttcgggacgatcatcatttctggtaattaaatcggtgctatcaaggtcacattttagttcgtttttcggttttgcaagcaataaattataagatttttgacatttttgacaaaaaagtcgctgagaaagacgcgaaattatcgtctcattttttatttttagataaaaaacacaatctagattgatgccatttttgatcataaattccaactgttgaagcgttcgaggataaccatcaagaatataaccttgatttttagggatttttttgataaaatcagcaactaatttatttgttatttcatcagggacataacttcctgaacttaaataattttgaatttgtgctgcaaattgggaatcttcactaattttttttcgaaaaagatcacctgtagaaatatgaactaacttgtatttttcaactaaaatttttgaaatagttcctttacctgagccaggagctcctataaaaagaatttttttattgcttttcatttttaagtttgccttcttttaatcaaaaatgttaaaaattaaattttaccataaaagatcctgatttgaatcaatagaaggagaattttttcgaacttgtaaatttttgcggatctttttactttgttttagaactttttgtgcatcataacgggctttgatctgcgaaatcgtttcaagtgtagttgttgctaaaattattatcgaagttcctgaaattgtgattgccgaaggaagacctaacataatttcaacaggttggagaattcctaaaaaggtaagataaatcgcactgaaaactgaaagtcgcaaaaccactgaaattaaataatcttcagtctgttctcctgggcgaatcccagggataaaagttgaatttttggcaaaatcctgtgcaattttatcaactcgggattgttgtaaggacattattattgaaaaggagacattaaaaacaataaaaatgataagaccgattgggtgataaatttgcatattattatctattcaattccgaactgctgaggtatttctatcaagaaatccgctaaaaagtgtcggcagtgaaacgataattaaggcaaaaattacaggcataattccagcaggatttaatttaaggggtaggattgaaatttccttaatattttttgacatacctgatccggtttgttgaattggaatttttctttcagctaaatacacataaatcgcaattaataaaataagtaaaaatccaaaaatataaagaataaaacttaaaacctgagaaattagcgaagaggagaaactaagatcgacaagatactcaaaagcgtgttgaaaacgacgaggtagacccactacaattccagaaaaaattagtaacgaagtaccatttccaacgcctttatccgtaatttgttcggcaagaaataaagaaaaaagtgaacctgctactaaaacaagcggcaaaaccaaccagataaaaactggtgtattaatttcgaggcgaacaaacccataatcaggattaagaatgactgttcgtattagcacaacagcctggataactgccactaacaaggtaagaaatcgcgttattatgttaatttttcttctacctgcagggcctgattgtgatagccgatggattggagggaataattttgtctgggcaattagcataaataaagatgccgtaatgaacgggctaattccaagagcaactactgaaaaattcagcaacccgccaccgccgacggtatttataattcctaaaaaggaattagaatcaagttgaaactgtagcaatttcaaccctgggatagtaattgtaccacaaactataaaaattacaagtaaaaaaaatgtaaaaattaatttgcgggctaaaattttttccctataggcaaaataggctcgatttttcagactaacataggcagaatttattccaagtcaaaccttagccaataattttagcactagcgaacctcgatttttccacccttttcttcgatttttttctgcgcggctattgaaaaagcattcgtggtaactgttaactttttagttagatccccgtttgcaagtaatttagctttcatatttcgttttttgaggacctttttaagatacaatgactctaaactaacagtatccccgtcttggtagcggctctcaaggtcactaatattgaaaatttcgtattcttttttgttaaagtttcgaaatcctctttttggaacccggcgaaaccaaggattctgacctccctcaaatccaagacggactgttgaacgttttttttgccccgactgacctctaccggcttgtttaccttttccggcggcatgtccacgtccttttcggtgtttttcttttcttgccccaggggtataactaagattttcaagtctaattgacatttttcttccttattttctctaagtttgataattatactgtatttttttaaaaaaccaagttttttttaaaaaaaaggaaaaatttgggaaaattagccagtttttccaaattttaaactttttgcgcctgcgcttgctgtgggcttaaatcacgtaattcggctacttgattaattgttcttagtttcaaaagtgcttttaaggttgctctgaccacgttgatttttgttcttgatccgtaagtttttgtataaatatcggtatatccggcaagttcgactacagctcgcactgtatttgaagccacaattccttttcctcttggagctggttttattagaatttttgaggctagatacttaacagcaatttcatgaggaacagtggattttcgataaattggtacacttacaaggcgattttgggcgtcttttattgcttttttaactgcatcttggacctcattagctttgccatgaccaaaaccgactcttccttttttattaccaactaccgcaaaggcactaaaagaaaagcgacgaccaccttttaccactttaacaacacggtgaattgcaattactctttcttcgaattcaggtttagaatttttatcccgcgaattttttctaagcggtctacgccgttgaattggtttaacttcacgtgaatttaaagggttttttgcaactgattgggaatttagttctacttttggatcttgatttagtagatctttttggttttcaagttttctatccatactagaattttactccttgatctcgcagggcatttgcaaatgctttaacccgaccatgaaaaagataaccaccgcgatcaaaaatataagactcattttccaaattaagctttttcatctttttatataaatcaggggctaaacttgaagctgagacaatattacctttatatccatttgacttatcaagagttgagaccgaagttattaccttattttttcaaggatcaaaaatataagcataaaagttgcgtaaggatttataaataccaattcgatatttttgcttgtcttcacggtttgattttaattttttcaaaatccggacatgttttgctttacgataatagttacgtgatttttgcataattattttgaagcttttttcccttctttgagtttaagaatttcatcttgataagaaattccttttcctgaataagcatttggtttgcgcacttgtcgaatttgggcagcaaactgaccgactttttgtttgtcgatccctttgattaaaatagtggttggatttggaactaaaacatcaagttcttgcggaattctgatctcaacaggatgagaataaccgactaaaagttcaattaaattttcttttagacttactttataaccaacccctttgatttttaattctttctgaaatcctttagagaccccgattatcatcgcagataaatgcgaatttgtagtcccatgtagttgttttatttgttttgtttcagaatttcttgttgtttttagactttgattttcaagtaaaattgttatttcctttgcaaattgtctttcgaggatacctaaaggtccttgaactttgacagatgatccttgaatttcaattctaacttgttcaggaactttcaaaatacgattaccgactcgtgacataattttttaccaaatataggcgataatttcaccacctacattttcctttcttgcttgtgaatcagttagaagaccttttgaagtcgaaagaattgcaattccaaaacctgattgaacaaaaggaatttttgatgcacttgtataaacccgcaaagaaggtttggaaattcttttaagaccagaaatggaagaaagatttcctttgtatttaagctcaacagtgatattttttttaagatcaccttcaacttgaaaatccttaatataaccagctttttggataatttctaaaatttttacttttgtttttgaatgctgaaatgaaacatttttatgttttctaattgttgcgttccgaattcgggtgagcatatcagcaattggatctgttataaaagccataatttttaccaactcgctttcttaattccaggaattcgtccttggtgcgctaaaactcgaaaacaaatccggcaaattcgaaattttcttagaactgaatgagaacggccacataactgacaacgagtataggcgcgaactttgaatttgggagcccgatttgctttaacttttcaggatgtttttgccatatttttcctttttttttatttaaaattagtaattttatgctaaaaattatacttttttagcaaaagggaaacctaataattctagtaatttaaaaccttcttgatcattttttgcacttgtaacaattattacatcaagtccccgaattttgctgattttatcaaaagtaatctcaggaaaaacgattgattctttaaatccaagggcaaaatttccatttccatcaaaagatttcggggaaagtccacggaaatcacgaacccttggaattgcaatgtgcagaacttttgctaaaaagtttcacatctgctgtcttcttaaagtgactttaccacccattggcattccttggcgtaattttcaagttgccaaggatttttttgctacagttttataggctttttggccggtgatttttgctagatcttcaagaacagcttcaatcgctttggcattacttgactggtttccggcggtcatattgacgacaactttagtaatttttggcacttgcgaaggcgatttgaagttaaaatgtgcttttaattgaccaaaaaccttttcataataatgtttttcaagttctatcataacctaaattgcctttccggttttttttgcaatgcggatttttttcttattttcaatcttaaaaccaactcgggtaggaattgcgggcttatcttttgttgcttttttggcaactaaagccaattttgaaagcaaaattggggcttcaaaagtgataatttcgccacttgtatttttatttgaaggttttctgtgttttgttttgatattaactcctttaacaatcgctgctttttttgctgggattagttctaagaccgcgccttgctttcctttatcatcaccagataaaaccacaactgtatcatttttacgaatttttcccatttttttataaaacctcctgcgctaatgaagctattttaagataacctttttcccgaatttcccgggcaatcggaccaaaaacccttgttccccggggagttccgtcctcttttatgatcaccacagcattatcatcaaattttatatgagttccattttttcttctaagtccataagttgaccgaacaattaaagctttgactacttgaccttctttgagcattccgttaggaattgcttttttaacagaaactacaacaatatcaccaatatttgaagttttttttaccgaaccacctagattgcgaattacacccacgatttttgcaccggtattatcggcaacattaaggcgcgaaagttcttgtagcattctagatttctccttttttctgtaagacttcgactaaacggaagtgttttgtctttgaaattggccgacattcggcaattttgacaaaatcacctacttctgccaggtttttttcatcgtgagtgttaaattttttgcgctttttaaacctttttgcataaagtttatgtttgtaggcggtttcaacttcaaccataattgtttttggggaggttctaatgacaattccttgtaaagttttccgaagatttcgggtttgagcttttttttctaaagttaaattattcattttcagcactcatttcttgctttttaactagatttttttgaatttttgggactaaaagtggttttagttcatctctaaaatgggacttaagtgattttggctttaccaaagaggaaatttttcccacctttttcgctttttttcttggttttttcagctttggtacttcttcaagttttctttgggaaataattgttaaaactctggcaatcattttccgcatctcgccaattttatgactttgatctaaatttgagctttgatttttaaaacgtaaggtgaataactcggaacgatattcaagaagtaatgaatttaattcgcttgctgttttttttaaaagttctttaaattccataattttcctaaactgttgctacaatttttcatttaagcggtaatttatgtccgccaagtcgtaaggcatcccgggcaatttcatcttttacccctctgacttcaaataaaatcgtatttcttttaaccacagcgactcaacgatcaaccgaaccttttcccgaacccattctgaccccaatcggttttgaagttagtgctaaatgcgggaaaacccgaataataacttgcccttcacgacccatccttctagtaattgcgatccgagcagcttcaatttgggcagctgaaacccaagccgatccagtagcttgaagaccataatcaccaaaagcaacaaaattaccagaatgcgcatcgcgtttgtcatgataaagtcgaaaagttttgcggtgttttgtttttttgggttgtagcatttctatctccttttatcagctcgtataattgcatcaatatcagttttttctttgatttctccaagtgaaactcaaacctttacccctagaatcccgtaagtagttttggcgattgcagttgcatattcaacattttgccttaaagtatgtaatttcatttcaccttcagcatatccttcacagcgagccatttcaactccattgagtcggccacagacaatcgttttcacaccggttgccccgttttttagggcagttcgaattgcaaatttttgggcaattcgataggatttacgctgctcgagtttttcggcaattaattctgccattaattttgcatttaattccggactttggatatcaactgcatcaacatttataacaattttgcgattttttagagtttttcttaatttttcaactatttttttcagattttcgcctgaagcaccaagaaaagaacctaattttgctgtataaacaagtacagtgattgcattatttcggtcacggcgaatcaccgtatttccaatttgatattcacgggtcaacttttcaaaaaagcggtggattttgacatcttctaataaatttatcgaaaatttatttttatctgcataccaaattgcattatgatttcttgtgattccaaaacgaaaaccgtttggattgactttttgtcccattatttaacctctttttcttgcgctaaaaccgtgtttgtggcatcgtttttagtattattatccgctaaatcagtttttttggcggttgtaatactatttgtttttgctgataattgggaatcaaccccattttcggggtcattttggggttgttcagcctggctttgctgggagagcgccccactttgggtattttccggggattttgaaactagatttttttctgtttcttgatattcttgattttgactttctccgccgttttgactggctaaaataactttaaaatgggatgttctttttaaaatttggctcgctgcccctttagcgcggggacgaaaacgctttaaagttggaccctcattgacaattgcagccttgataattaagtttgaatgttcaaaaccgtggttgttaatcgcatttgcaactgctgaattaatcaattttgtaaaaatgggtgaagccttttttttggtatgactaagaattgctagggcatcagaaacttttttccccttgagtaaaaccgccacaaggcgggctttgaatgcggaaattcgctgtgttttgagtgaagcgactgctaaattatgattttctaccttcatttatttaccttttttatttttttgccttatcttttccatgcccgtgataagttcttgttggggaaaactcacctaacttgtgaccaaccatatcatcagttacataaacctcgttaaaaatttttccattatgaaccaaaaaagttagtccaacaaactggggaaaaatagttgacctacgagatcaagtcttaattggttttcttgagtttttcgcaattgcttcatcgacttttttcaaaagatgatcatcagcaaaaggtcctttttttagtgaacgagccattattttttagtttcctttcttgagcggattatcaatttagttgaaggttttttcgggtttcttgtcttaactccaagtgcttttttcccccatggagtcagcggtgattttcttccaattggctgttttccttcaccacctccatgagggtgatcgttagggttcataaccgaaccgcgaactgtcggtcttattcctttatggcgatttcttccggctttcccgatattaacaagtgaattttcttcattaccgacaacgccaattgttgcccggcaagttgctaaaatccgacggtattctccggattttagctttaaaattacgtattttccgttctcatcgcgaccttgaatttgggctcaagttcctgctgagcgaattagttttgctcccgcacccggttttaactcgatattatgaacaaaagttccttccggaattttagccagtggaagtgcatttcccactaaaatatcagatttgggtcctgaacttattttttggcccactttgaggttttttggagctaaaatataacgtttttccccgtcaatataggaaattagggcaatatttgctgacctatttggatcatattcgattgttttaacaattccagtaatatcatccttgtttcttttaaaatcaattaagcgatattttcttttatgtcttccgccttgatgacgaactgtaatttttccttgcgaatttcgacctgaatgtttttttagaattgtaagcagcgatttttcgggcttatttgttgttaaatttgccccaaaatcaagcgaagacatatgacggcggccgtttgttgtcggtttataatacttaagtgccattatttgtttctcctttctgaagatttttttgtctttatttttccgagcgctaaactagacatttttttggtcttttttagtttttgtgttttcttttctttgaaatattttccggctcggccttaattagcactattttcctggttttcggtttgattttcaatccttttttcttgattttcgttagtttcagaatctttttttgctaattcggcttgttttttagctaatttctctgcaatctctttgtttttagcctctaattcggcttttttcttggcaatttttgctttttcttcagtattttcgcttacagtttcagaatctttttgatcttgaggactttcgtcttcaaaaagattaattgtataaccgggcatcaattttacaagcgcctttttatatttggtagtaaacccttttgattttcctagttttttttctttttttgggacagtaaaaatatttaccttttcaacttttacattaaaaatgtattcaactgctttttttgtctcagaacggttagtttttggactaactttaaaagaataaacgccactagacattaattgataagatttttcagttaaaattggaccttttattatttcatttacattcattttttagattctcttctccaaattagtaatttcatttttggaaattattaacaaatcggccttaattagtgattcaactgttagcgaattcgtttttaccagctcaacatttggtaggtttcgtgccgataaaaacaaattcggatcactagaagcgattaaaatgtgacgaagttggtcaattttaaaaatttttaattgatcaactagtaattttgttgaaattttattcattgaaaaatcatttacaagaatttgttgattttgagctagttgggaaagcgctgaaataaaagctaatttttttacttttttatttacttttaaattataatttctttgggtagttggcccaaaagcccgaccaccacctacgaaaattggtgatcttttagatccagctctcgcctttcctgtcgatttttgctttcagggtttttttccggttccagaaacttcagcgcggttttttactttatgagtagagagtctttttgaggccctttctgataaaatcgagtcaaaaattgcttgaaaatgtggttctttttgctcaaataatgacttgggtaagtcatcattagcattaaatttaactaaattttcagttttctgactttgaatgctaatttctgaaattttattcattttttacctctttatccgaatttggcacaaaaagactaactggattttttggattaggtttttttatcgctgattttatcactaaaaaagatttttttggaccaggaactgaaccttttaagactaataagttattttccttatcaacttttataatttctaatgattgttttgtaactttttcatgtcctaaacgccctggcattgtcatccctttaacaactttattaccagagatatctccaagcgatccagtttgacgaatcggttttgatccacctccacccccatgggatctaggtccgattgcttggttatatcgcttaattgttccggcaaacccttttccctttgaagttccggttacatcaacaaattcaccaggactaaaaattgagacatcaacagtttggcctaatttataaccttgaaaatcacggaattccttgataaatcgctttggctttgtatttgcttttgcaaaatgaccaatttctggctttaaaaaacgggactgttttttatcaaaagctgcaagttgaatcgcatcataactatttttttcttttgtaataattttagttacaatattttcaggaacctcaattatacttacaggaattgcaattccttctgttgtaaaaagttggctcattccaaccttttttcctagaattcctttcattttagcttacctcgatttctattcaaaccccagcaggaagttgtgatcttgaaattttttctgttactagtttttgatttgtaggtaaaactttcaaaattacaagtcttttgtgtgttcgactttcaaattgctcacgtgattttttattaatatgcactgatctaagaattgtataaattgctcttgaagtcggtagaggcaccggcccccgagtttctatattaagttcgcgagctagaagaataatttttttagccgcagcatcgatttgacgatgatcaaatgattttaacttaattttaattgatgttgtattcataaaaatatagttgagttgctcctgttcataaattttgaacgaactccacataaaaaccaatacacgataacaactcactctcgcgtactgcaaccttatgcatcatcatcctttaacggtaagattaaattatacacaaaaaataaaaattcaataatttttttaaaaaatttttttacccttagcagctaaaactagtaagtttgaaaagtctgaatattattactatttttccaaatttttaaaaaaaaaaaaaaaaaaaaaaaaattctctaaaaatgattaaaggtattgtaaaaattccaaagaagaggttcttaaagtcatttatttatattatacaggaaaatatttagttgatcaagaccagaaaagtataaaatctgagataaaaaacgtgattgtcagcttaatatcaaaggtaaatatccaaaaactagaaaaaaataatgccacagtaagcaaaaatccagtggttttgcaagctaaattaaaatccaaaacttgttaataacaaccaagttttggattttttgttgtataataatatcaaaattatttataatttattattggtgattttatatgaaagctaatttttctttcttttttaattcgatttttcggagaaaattacaaaaacgctcaattttagcgcttattttttgactaatttttttaataataattgctgttgtaattattgttgttcaaaaaaaagcttgatatgatgcaatctccatttgtgggcttttagccatctcgctttctgcccttggcagcgttcttagacttggattgtttagtagtttttcggtttcttatcataaatgaagaattaattcccagaataaaattttagaaaaacggggatttaaaacagaaactccaaaaattgactatgcttttattaaaaaaaaacagaaagaactctcacttttacctatttttttaggatttatttttggatttttacttttaattattagtcttccttttttaattcaaaattaataaaaaaatatagaagaaaatttcctagtaaagttctaaaattattaaaaaaacagcattaaaaactgctgtttttttaataatcctaattttaatattggattatttatttaaattgttcaaatttttttatactaaaataaattataaaagaagactgattagaaatttagaactattcaaatctttcaaaaaagtggcctaaaaacaatgataaaaaaatttccaaacttttttgttgcaaaaaaaaaaaaaaaaagtataattttaattgtacaagttaaataaatttttcacttatctttttttattttgcaaaacttttaaaaaaattagatatctaaattatattatatgattgagaaaatgaaaaatttatttcctagaaccaagataattgaggtttaaaatatgagtaaaaaatcaaaaacatttaaaattggtttgactgccggaattgttggtcttggagtttttggcctaactgtcggacttagcagcttggcaaaatacagatcagaaagcccacgaaagattgcaaatgattttgccgcaaaagtttcaacattagcttttagtccttatgcttttgagactgattctgattataaaatagtcaaaaggtgactagttgattctaataacaatattagaaataaagaaaaagttattgattccttttccttttttactaaaaacggtgatcagttagaaaaaattaattttcaagatcctgaatataccaaagcgaaaataacttttgagattcttgaaattatccctgatgatgtcaatcaaaattttaaggtaaaatttcaggcattacaaaaacttcataatggtgatattgccaaatctgatatttatgagcaaacagttgcttttgccaaacagtcaaatcttttagttgccgaatttaatttttcgcttaaaaaaattaccgaaaaattaaatcaacaaattgaaaatttatcaacaaaaattacaaattttgctgatgaaaaaacaagcagccaaaaagatccctcaactctaagagctattgatttccaatacgatttaaatacagcgcgaaatgctgaggatttagatataaagcttgctaattattttccagtacttaaaaatttaataaacagactaaataatgctcctgagaataaattacctaataatttaggtaatatttttgaatttagctttgcaaaagatagttcaactaatcaatatgtaagtatccagaaccaaattccttcgctgtttttaaaagcagatcttagtcaaagtgcccgtgaaattttagctagcccagatgaagttcagccagttattaacattttaagattaatgaaaaaagataattcttcttattttctaaattttgaggattttgttaataatttaacactgaaaaatatgcaaaaagaagatttaaatgcaaagggtcaaaatctttctgcctatgaatttctagcagatattaaatctggatttttccctggagacaagagatccagtcataccaaggcagaaattagtaatcttttaaataaaaaagaaaatatttatgactttggtaaatacaatggaaaattcaacgaccgtcttaactcgccaaatttagaatatagcctagatgcagcaagcgcaagtcttgataaaaaagataaatcaataattttaattccctaccgccttgaaattaaagataaattttttgccgatgatttatatccagatacaaaagataatattcttgtaaaagaagggattcttaaattaactggatttaaaaaaggtccaaaaattgatctccctaatatcaatcagcaaatttttaaaaccgaatatttaccattttttgaaaaaggtaaagaagaacaagcaaaattagactatggtaatatcttaaatccatataatactcaacttgccaaagttgaagttgaagctctttttaaagggaataaaaaccaagaaatctatcaagcacttgatggaaattatgcctatgaattcggggcctttaaatccgtgcttaattcctgaacaggaaaaattcagcatcctgaaaaagctgatatccaaagatttacaagacatttagaacaagttaaattgggttctaattcagttttaaatcaaccacaaacaacaaaagaacaagtaatttcaagtcttaaaagtaataacttttttaaaaatggacatcaagttgctagttatttccaggatttactcaccaaggacaaattaacagttctagagactctttatgatctagcaaaaaaatggggactagaaactaacagggcgcaattcccgaaagaggttttccaatatacaaaagatatttttgcagaagcagataaattaaaatttttggaagggaaaaaaaaggatccttacaatcagataaaagaaattcaccaactttcctttaatattttagctcgtaatgatgtaataaaatctgatggattttacggagttttattattgccccaaagtgtaaaaactgaattagaaggcaaaaatgaggcgcaaatttttgaagctcttaaaaaatattctttaattgagaactcggcttttaaaactactattttagataaaaatctacttgaagggactgattttaaaaccttcggtgattttttaaaagcatttttccttaaagcagcccaatttaataattttgctccttgagcaaaattagacgataatcttcagtattcatttgaagctatcaaaaaaggggaaactacaaaagaaggtaaaagagaagaagtagataaaaaagttaaagaattagataataaaataaaaggtatattacctcagcccccagcagctaaacctgaagcggctaaaccagtagcagcaaaacctgaagcagctaaacctgaaacaacaaaaccagtagcagctaaacctgaagcagcaaaaccagtagcagcaaaaccagtagcagcaaaaccagttgctactaatactaatactaatactggcttttcacttacaaataaaccaaaagaagactatttcccaatggcttttagttataaattagaatatactgacgaaaataaattaagcctaaaaacaccggaaattaatgtatttttagaactagttcatcaaagcgagtatgaagaacaaaaaataataaaggaactagataaaactgttttaaatcttcaatatcaattccaggaagtcaaggtaactagtgaacaatatcagaaacttagccacccaatgatgaccgagggatctcctaatcaaggtaaaaaagccgaaggcgctcctaaccaaggcaaaaaagccgaaggcgcacctagtcaagggaaaaaagccgaaggcgctcctaaccaaggcaaaaaagccgaaggcgcacctagtcaagggaaaaaagcagagggtgcttctaatcaacaaagcacaactaccgaattaactaattaccttcctgaattaggtaaaaaaattgacgaaatcattaaaaaacaaggtaaaaattggaaaacagaggttgaactaatcgaggataatatcgctggagatgctaaattgctatactttgtcctaagggatgattcaaaatccggtgatcctaaaaaatcaagtctaaaagttaaaataacagtaaaacaaagtaataataatcaggaattaaaatctaaataaaacccggaggtatttatcctatgaagttagcaaaattacttaaaaaacctttttgattaataacaacaattgccggaattagtcttagtttatcagccgctgttggtatagttgtcggaattaattcttataataaatcatattattcttatctaaatcagatcccaagtcagctaaaagtaacaaaaaatgctaaaattagtcaggaaaaatttgattcaattgttttaaatcttaaaattaaagataattttaaaaaatgatcggcaaaaacagttttaactgctgccaaaagcgatctttatcgttataatcttgtttctgcttttgatttaagtgaactaataaacaatgattattcagttagttttgatttagaaaatgcagtagttgatcaaaattcaattaaaaatgttgttatttatgcaaaatctgataaggatcaaataacttattcaaaacaaattgtacttaaaggctttggaaatacagaacaagctagaactaattttgattttagccaaattgattcaagcaagtcttttgttgatctttcaagggcaaatctaactttgatggaattccaaattttacttgcccaaaattttgaaaatgaaagaggaagtaattgattttcacgacttgaaagagccttggttgcatcaaaagcgagtctttcactttataattccttaggagaacccgtatttttaggtccagattatcaattagacccagttttggatcgaaaaaaattattaactttgttaaataaagatggaaaattagttcttggacttaatttagtgcaaatttcaactaaaaaaactatgaatttaaatcttgaagttcgcggcgcgatttcaaatcaggaaatttctaaaattctaaaatcctgacttgaaacaaatcttcaaggcaaattaaaaaccaaagatgatttgcaaatggcactagtaaaagataaaattagcctctctgattattgatatggatctccaaattcaaaagcaaatacatcccaaattttaacaaaaagtaaagaatttaaagatctttttgatttaagtgagacaaatttttttcttaataccaaaatcggaactgtctatttaagtattattcccaaacttttagatccaagtcagatctctgttgttgataagaaaaaactagttgaaaatcaaaaaattcgctttgaaattactgcttctttaaaacgaaaagctattgataaaaaatttatcatccaggatcttccagtttttgttgatctaaaagttgattttaataaataccaagccgctgttgcccaaatgtttggaacgataaaagcagttaaagaattttcaatgcctgaagatcaagatgcaaaaactttatcctcaaatgaaataaaacagcgagttgatcgtctttttgaactagcaaaaacagtgactaatttggaaaatccaagtgaagaagttcttaaaagcatttatttattaaatacgggaaaatatttagttgaccaagaccaggaaaaagtaaaacaagagctaaaaaccgtgattgagggcttaaaatcaaaggcaaatactcaaaaaacagaaaaaaatagccccacacaaccgaaaaaaccagaggtttcactagctaaaacaacagaaaattcagcaaaaacagtcaaggtaagcacttttgcagaagaagctaagggacaaagtcaaagtcagcaaacacaaccagtttccacttcatcccctcaaactagtcaaaatttgaattctaattccacaaccagtacgaatttagccttagaaaatgaaaaatttgggacaagcatttgaacagcttttaatttcgctaatatttataatcttgaaaatacaaaaagcgaatatgagatctcaactttaggaaataagctattttttgattttaaattagttgataaaactaatcaaaatctaattttggcccagtccaaaattagtcttaataatattattaattctaataaatctgcctatgatataattaagaaattcaatcccgatgtatttctagatggaacaattaattatcaagatcaaggaaaagataaaaaagaatttatcctaaaagatttaagtgataataaattaatatttaaatcagaagatgcaattcaaactgatcaaggtttagagctaaggaaacctttgaaattacagtcaaaaccgtctaatccagaaaaagaaatatcaacttctttatataccggagcaatttatttagtttttgatgcaaaaaatatttctgatggtaattggattaatcttttagccgatagaaaaggaaaaggacttgtaattaaagttaaaaattcagataataacatacctaaaaccaaagaaattgttgaaaatggtacttatttatatgaaattcttgctggtaaggattcaattaaggtaaattcttatttttttccaacaaagtacccaaaacgtgtaaaacgtcttaatttcaagattaaccctaaagacaccttgccaaatttctttactttagaatgatttcatcttgattggtatcaaatcggcccaggcgaacaaaataaaaaaccacaacaaaacgctaaaaaagaacctacaattatattaaaaacgctggcaatatttaatgataaatcatttgcagagaaaggaagtttaacaaaaagaagtgaattaattaacgggttgattagaaactatgttaaaaagtaacgatcaaatttttgttaaaaaacagaatttagtaaaaattccagtttaaaaaataaattaaaattaaaaaaagtacaataaaaacaaagaagaattaatctccaaaaacttatttggagattttttatttaaattataaaaagcaaaccctaattaaaagtggaaaaaattaggaaaaagaagctatttttacttttttttgattattttataattttttgataatattggtgatatattattaaatctattttttcgttgaaaaaggatgtttaataatgcaaatttttataaaaatttgcatttctagccaaaattaatcttttatacattttgttaaaagaaaaattgctgctgtctccgatctaagaattcttttcccgagtgtgatactttgaaaccctaatttttctgcttgttggatttcaacatcatcaaacccaccttcaggcccaatgattataattgtattttgggggttatcagggatatttatattattttttgctctttcaaaactgattaattttactggaaaatttttggcttgttctaaaagatccttataatttataggtaaatttattttcgggatcaaattgcggaaactttgttgggcgctatgaagacaaatttgttctcatcttttgagttttttttcaagatctccgcttattttttgggaaacatttttactataaaaaggtcaaatttcactaaccccaatttcaacagctttctggattgcaaattcaaatgattttgtcttcaaaattgcaagcgcgagaacaactttgttttttggttcgttattccccttaattttttcaattatttctgctttgtttgaattaggcactaatctcacaaggtagaattcattttgataaacacaaataaaattttcatttctaattcttacagttttaatatggtttaaggttatatttgttaagataaagaaattttcttgtttttcattgacaaaaaagcgatacataataaaaattttaaaggaaaattgataaactatttaaaaaatagtttaaaattattaaaaaagaaggaaaaactatggaaaaattatcagcaaacaaaataagacaactttgaattgatttttttcgcgaaagaaatcatttttttatcgaatcaaaaccacttgttccccaaaatgatgactcacttctttgaataaattcaggagttgccactttaaaagattattttactggcaaaaaaattcccccatcaaaacgacttgtaaactcccaaaaagccttaagaacaaatgacattgaaaatgttggtctaacctcgcgccatcacaccttatttgaaatgcttgggaatttttcaattggtgactattttaaaacagaagcaattgactatgcttatgaatttttaactaaaaagttaaaattagatcccaaaaatttgtttattacttattatgatggtgatgatataacttttgaaaaatgaaaaagtttgggattttctaatgaaaaattaataaaaggtagcagaaaaacaaatttttgggatttaggtcaggggccttgtggtccttgtagtgaaatttattttgaccgcgggccaaaatttgatagtcgagggagcgaactaatcaaaaatgagattgaaaatgaccgttttattgaaatctgaaatatagttttttctgaatttaacaatgatggccagcaaaattatacaccattaaaatcaaaaaatattgataccggagctggctttgaacggattgtttcgattttacaagatggcccaactaattatgataccgatctttttctaccaattattgctgaaattgagaaaaacactgtttttcgatacaaaattgagaactattttctaaaagaacctcgacaaacacaaattaataaaagttttcgcataattgccgatcatattagagcaataactttagcaataaatgacggggttcaaccttcaaatttacaccggggatatatcattcgccgcttgattcgtcgagcatattggaatggaaaagaattaggaattagtcacccttttctttataaattagtggaaattgttggcaaaactttagattatcgttttgatattccaacaattagcaaaattattctcaatgaagaagaaaattttgcaaaaaccttggaaatagggtataatttacttgaaagtcaactaaaaattaacaaaaatcagataaaacctgtgactgtgttcaaactttttgaaacttatggttttccggttgaactaacaaaggaaattcttgctgaaaagaacattgattttgatcttagtcaattagtggaatttcaagaaaaacattcacagatttcaagggcaaaaaaaactactgggatgcaaaaagtgattaattcactaactcaaattaaagctaaaatttcggattttattggttatcatactcatcatattgagaccaaaattagctttttagcgaataaagacgaagaagtagctgaaacaaacggtgaaaatttatcttatgtaatttttgaaaaaactcctttttatgcaacagccggtggtcaaaaacatgatcaaggctgaattattcaaaataattcaacaattgaaattcttgatgtttttaaagataaatttttaaataatattcatgtctttaaagggaaaattgttaaaaatcagccggtttttcttaaattagatacaaaaaaccggctgaatttagagagaaaccattcaggcacccaccttttatttgcctcacttagacaagaatttggctctgagattaaacagttaggatctgataataatgaagatcgcctaactttcgattttccacttaatcgaaaaccaagtgatcaagaaataaaatcggttgaaaatcgcataaattcttacataaatcagaaaattaaacggaaatacctagttacaaatcttgaagaggcccaaaaactcaatgcaattatgacactggaagaatcagaatatatggacccaaattcgttacggttggtgatttttgataaaatcacaactgatttatgtgggggaactcatattgaaaatacagaattacttgaaaaatttacaattttaagctgccaaagcaaagggtcgggaatttatcgaatcagagcagttacttcctggaataaatattttgagtttttgaaaggaaaaattcaggaaattttaagtaaaatttccgcattgaaaaacaaaattaagaaaattgagcctaattttggcctaaatttaccaaatttagttgatttagagcaacaatttgattacctaaaaaaaatagaagatgatctaagaatttattataaaaaacttctaaaatcacaattaagaatagcaaaatcggaacttgatgcaaataaaataattgaaattggcaaatttagtttttatttagattttaaccttccactgcataatttaaagcaaatagccgccacctgaagagaacaaaatccaagaatatcctttattttaggtgctaatttagttaataatgaatttttaatcattgtttcttctgcaattttagcttctaatcaaattcttgaaaaaatttttgaaatttttactggctcaggaggtggaaattataagattgcccagggaaaaattcaaaaaaaaccagaaaaagaggtgttcattaaacttttatgggaaaatataaccgaattttagcacttgatcttggcatcaaaacttgtggatttgcaatttctgatcaaaactgaaaaatttcctatccacttgaacagtttaattttaatcgttatgattttgccagtgtaatttcccgaattgcattttgaatgaaggaatatccaatttcaatcttagttctaggttatcctttaaccttagctggtaaaatttccccgcggacaaaaatggttgaatactttgctgatttagtaaaaaaaaactatgaaattaaagtggtttttcaagatgagcggctgactacaaaacaagctcaaacttttttattagatttaggaatttcctttaaaaaacggcaaaaagtaattgataaattagccgctcagataatattagaaagatttttaaatacaaaaaaaggataaaaaaaatggataaaaccgacaacaaaccagaaattaacctatccgatgaagctcgtttaatcataaaacataacaagctcaagggaaaacaacccgtctatgagaaattttatttaattttttataaagaattagaaaataaacgtcttttttctgtgatgtttgatgaagaaagaaatattttagtctttgaagttgatagtaaaaccttagttcctattaagccaatttctgaattagatcaagaaattcatcaaattattgagaaggagattcgaggattttttaaagaccattattttacttttgagggccaaagaatttttcctgaaattttttttaataattttgatcctatttccgaatttgatgatataataaattttttgcgtgatgatgaagtaattagccttccaatttgactccaaaaataaaaaaataatataaaaacaaaggtaaatttagaaatgaaactaattgtcggccttggtaatcccggggagaaatatgctaaaaccaaacataatgtcggctattgagttctcgatttactagcggaaaaattagctcttagttttgatcagaaaaccgaaaatggaatttatgtaaaacagcccgattttattctagcaaaaccgacaacttttatgaataagtccggcgattttgtcgaggaattaattaaattttataaaattaatactcaagatttaatgattatctatgatgatatgaattttgaggtcggccaggcagcaatcaaaacaaccggcagtgccggtggtcaacgcggtatggcccatattatcgaaaaatgcaaaacaaaagaaattaaaaggctaaaaattggtatttctcggggcgaaaatgcaaaagaatatgttttatcaccctttttacctaaagataatgcaaaaattaaacttgtaattgaagaagcagctaatattctgattttttatttatctaatagttttattacaacaatcgaaaaatttaatgcaaataaaaataaagtctaaagaaaaatatttaataggtgtctcaggtggctctgattcaatgtttttgctcaataaatataaaaatcaggatgtaattgtagctcatataaattacaatttgcgccctgaagcaatttttgagacacttttggtttcaaaattttgtcaaaaatacaatttagagctgaaaattctatcatttgatagttttaagattaaaaaaaatttacaaagcgggcttaggttgggccgttatcaattttttgaaaaaatttataaagaatttaattgtactaaattattggttggtcaccaccgtgatgattttcttgagacagtttttttgcagaaaaaacagaaaaaaattgtcactttttgaggaatacataaaaaaaataacctttttaatatggagattttgcgtccttttttgtattggagaacaaaaaaacaaattattcaaatttgtcaacaaaaaaaaattccctatcttgatgatcaatcaaattttacgggcaaatatcaacgtaatcaaatcaggtttttattggaaaagaagagtgatttttcacttttttttctttttttattttattatttaataaacatatttaaattaataatattaaaaaatcagaaaaaaattttgcaaaattgacagaaaacagggtataatataaatttctttaagaagataaaaattaagtcaaaaattatttttttatttgttaatcaaaattttgataatgttaaattaactagggggaaaattaacgaaattattaattttatttgcgggaaatcgactagtggggcttttttactaaaaaaaaacaattatattataaaaaaaaagtgaaaaatattgccaaaatctagtaaaatttagtaataatttgtattttatttataaactggagggtaaattatggcagcgaaaacaagaaaaaaaccttcaattggcctgataatttttttagtaattactttgtcaatagtaggttatataatttatcaatatttgcagccgcaacttaaggttgtaaatctttctttttttgaacgtagattaatcgaaaatgctcaaagtgcaactgataaaaactttttttatgctgttattttcgatattaatgactacagaattaaggttgttgattccgttaatggcgaattagatgcctatacagtcattgctaatccccatgtgattggtaaatttcaggcaggaaatgcactaattagcccggcaattaaaaatcaactcgaaaataccaatattacaacttattctgagttagtctcacttgcaattaaaactagcccatcaagttatactggcctttcacttgaaaaaatcagcgcgcttaataaattattagatctcgcaggtggagaacgctattcaaaaagttttctcccttcaattgcttcagctgaccgcccatatccttcactttttcaaattattctctcatatcttccagtcgcagttaccatttttgtattcctttattttgttttcagggttaatcgtggatctcaagggggggccggattttttaatcctggtaaaaaccaagcaataagaattaaatccgataaaaaatacactgatgttgccggaaatgttgaggcaaaagaagaaattgccgaatttatcgactatttaaaaaatccaacaaaatatgctgctgctggtgcaaaaatcccgcgcgggattttattaggcggcccaccgggaacaggaaaaactttattagcaaaagcaactgctggtgaagcgaatgttccatttttctttatttcggcatcaaattttgttgaattatatgtcggagttggtgctaaaagagtccgtgaattattcaaagatgcccgaaatgactcccctgcaataatttttattgacgaacttgatgcgattggccgttcccgtgggtcaggaatcggtggcggaaatgatgaaagggaacaaactttaaaccaacttttagtcgaaatggatggaatggtggaaaattccggacttttggtaattgcagcaacaaatcgaaccgatgttcttgatccagcacttttacgtccgggaagattcgatcgatcaataattgttaatctacccgatataaaagaacgcgaagcaattttaaaattacatgcaaaaggtaaaagaatctccaaaaatattactttggcaaacatagccaaacgaacaccaggattttctggggcccaactggcaaatgtgatcaatgaagcaactttactttcagttcgtgagcagactcaagtgataacaaacgaacaaattgatgaggcaatcgatcgggtaatcggtggcccagccaaaaaaaaccgggttataactgaaaaagaaagaattatggttgcctaccatgaagctggccatgccgtagtgggacttaaattaaaatcaggggtaaaagtccagaaaattacaattgtacctcgtggaaacagtggtgggtataaccttatgcttccagaagaggaaaagtacaatagtacaaaatcggaacttttagcctcaattgctgcatttatgggtggtcgagctgctgaggaaattaagtatggcaagtcggaaatttcttctggtgcagcaaatgatattgaaaaggcaacaaaaattgcccgaaaaatggtaactgaatgagggatgtcttcacttggcccaattcagtatgaacaggatcaatcatccccatttttagggcgtgattatataaaaaatgcctctttttcctccaaagtcggccatgaaattgacattgaaattcgtcagattatctctgaatcatataaaaaagcttttgcaacaattaatgaaaatttattgcttcttgaattaattaaagatactttattagaaaaagagacaattgtttacgaggaaatccaacaattagccgagacattaatgccgcttccggaagttagtaaaaccgaaaataatgctataaaacccgatgagattcttaatcaaattcttaaatcccaaccagaaactagtccagaaacaggaacagattcaagtcaagaaaatttctaattacaaaaaaactctatttttactaacttttataaattatttttgaaatttgcaaaagttagtaaaaattaaaaagttttttcaaaaaaagctttttaattttattaaggtgatgaaaattatgtcaaaactaaatgatcaacaacaatttcgccgggataagcttaaaaatttagttaaaaatggttttaatttccctagttcaacttttgagcatgataatttagtagaaataaatgaaaaatttagtcaaaaatcgaaggaatttttccttgaaaatcaagtaaaaattgcttttgctggtcgacttattcgccaacgcggcccattttttataatttttagtcaaaacttgcaatttcaagcttatatttcaaaagaatttcaaaaaaaaaatgaatttatctttgcaaatttagatcttggtgatataattgaggtttcaggttatcttttcaagacgcaaactggtcaacttagtattaaagttaataatttttctctgcttacaaagtccttgcaccctttaccagatcagtattatggtattgaaaatccagatgagaaatacaggaaacgttatcttgacctgcttgtaaattcagaatctgcaaaaacttttcgacttagaagtaaaattatctccttaatccgtacattttttgattcccaaggttttttagaagttgatactcccgttttacagccagttttaggcggggcatcagcaaaaccttttattacttattataattctcttagtcaaaatttttatctccgaattgccacggaattaccgctgaaaaaattattagttgccggttttgaccgtgtctatgaaattggtaaaatttttcgtaatgaaggttttgattcaactcataatcccgaattcacctcaattgaattttatcaggcttatgcaaatttagagaaaataatggatcaaaccgaaaatttatttcgttttttatttgaaaaattaaatcttgatccggcaaattttgatttttcaaataaaaaaattaatttcttggaaaaatttgcccgttatgatatgattgagattacttcaaaattaatgaacttcgatttaaaaagtgctaattttgctgatttagtcgaaaaagcaaaaaaagaaggggtgaagatcgagccatttttcaaaaaagggcatctaatcaacaaattttttgaaaaatttgttgaaccaacactaataaatccaacttttatcataggtcatccaattgaaatttccccgctagccaagtcaaatccaaacaatcctaattttactctcagggccgaattatttatctgtggtaaagaatttgcgaatatgtttgatgaattaaatgatccaattgaccaattaagtcgttttcaagcccaaattatcgaaaaaaatcagggaaatcaagaagcaagtgagatcgacaatgaatttgttcaagcacttgaatatggaatgccacccgccgggggttgtggcattggcattgacagattgacaatgcttttaacaaagaatgaatcaatccgtgaggtaattttattcccacagctaaaaccaaaaaaggactaaaatgaaactattttttgcttttgacctggatggaactttattacgttatgataatacaattcatcctgaaaatgtagagattttaaaaaaactctatgaattaggccactttttagctctagccaccggccgaggactttctggctgccttgatttagccaaaaaatatccttattttcattatctagtttcaaataatggaaccttagtccatgatactaaaacccaaaaaaccatcaataatggtagccttagcaaagaaattatctttgatttgatcaaagattgtaaagcaactgattcgatttgtgctttctcgagtcctaataacctttttgaattttcaagtacaaacaatcatccctgactaaaaaaacagaaaataatggacctgcacttctatgaaaaagtagatcaggataaattatatgaaatcatcgaaaaagaggaaattacccaagttgccttccgtaatgatattccagtgattgctgaactttataaaaaatggtcaaaaaaactaaaaaatatctataaagtaacaattacaaaccgtatttttcttgacataaaccctttaaatgttgataaagctaacggaattaagatgctattagaaaaaaataacctaaaacctgaccagttaatcgcttttggtgatagttcaaatgattattttatggtaaaattagctcgttttggttatgcaatggaagattcaacccctgatttgttaagcgttgcttatcaaaaaattggcaattgtaactccggatcaattgccaaaacgataaaatcacttttagaaaaacaagaagagctattttcctaggcaaaattttgaaaaaattgaatcaagaagattttcatcatcaactcggccaaaaatagtttttaattcttttcaggcaattctgagatcaacaattgcaatttcaggaccaaaaccagattctaaactggtttttgcatctagaattgctaattttcctagctcaatttgcgaaatttggaaggaattagcaacaaattctttgttttttcctaaaaaagcaaaaattgacttgattttttcaagtaaattttcaattttttgatattttgcactgattaaaatttcatctttaaattcctcttgattttcaagaagatctgatttattataaattttaagataaatctgatcaggtcgcgtttttgcttttagatctaaattttgcctgtttttttcactagcatcaataatgtgcagaattaaatccgcttttttgatactttcataagatttttcaataccgatttgttcaattttttcagtagtttttctaattccggcggtatcaaaaagtttaaaaagaagaccgtcaaggacaaaatttccctcaacaacatcgcgtgtagtgcctggaatttcgctgataattgccttattttcgttaattaaaatatttaaaagtgaggattttccgctgttgggcgctccgacaagacaagtttttatcccttgataaatcaggcgcgaattatttgcgatttttattaactgatcaaaatcggctaataattggttaattcttggcaaaagcacatctgaggttaaaatttcaacatcatcatattctggatagtcaatatttacttcaattatcccgataatttcctcaattttttcaattaaatttttaataaaattagaactttttcctaaaaattgatttaaagctgcttgatgttgaacttttacctcagcatgtattagatcattaatggcttgggcttttactagatcaattttcccatttaaaaaagcgcggagactaaactcacctggatttgcaaggcgggcgagtttggtttttaaaataagctcaagaattaaatttgtatttagaacaccgccgtgagcattaatttctacagtgtcttcaccgacaaaatttttatttccagcaaatcagagcactaaaacttggtcaattttttggttatcatcatgaattcaaccaaaagttatctccattgaccttccgactttacctaaaaaaattttttccataattttaaaggcattagggccagaaatccgaatgattgaaattgcctggtttatttgcccagaagcgattgcacaaattgtatcagaaagcaacttaaattctcctataaaaaataaaaaatagaaaaaattaaagctaaattcctatttttttctcatattcagccaaattcccttgaaaaaaaattgcactatcttctttgatatctaaaataacattagcaacttcgttgatcaaagcaagattaaaagtggtaaaaattacccctgagtcataaagttttaaagcttcaatgaatgaatcaatcgattcagagtctaaatgattaagtggttggtcaaaaagtaggaaatttgactcgcttaacatcatttttgcgaacatcagacgaactttttcacctccagatgtaactgaaacttttttaaaaacttgatcgccattaaaaaacatccttccaagaaaacctcgcattctctgggtagaattatccttgttttctggttgtaaattaagacttggccattgtgaaattcaggataataaatcaagatcgccgttaaaaaaactatcattatttgctggaagatagtcaaatttgattgtcgaacctcaactgattgttcctgaagttggcatttcttttcctgttaaaatttcaagtaatttagttttaactaaatcatcttcggcaaaaattaccattttttgacctggtaaaagattaaaagaaatattttgaaataaaaaattacctgtaagtggatttttataacttaagttttcaacatttaaaacttgttttcccggccgcgggaaaactccaaaacgaatataaggatattttcgtgaggagggtttaatttcttctaactggattttttcaagtgattttttccgggaagttgcctgggctgattttgaagcatttgctgaaaatttggcaataaatgcttctaatttggcgatttgctcctcttttttagcattagcatttttctggagttcctttagtagttctgatgattgtttccaaaaactgtaatttccggtaaaaatttttatctcgccatagtcaatatcaactgtatgtgtgcaaacttggtctaaaaaatcgctgtcgtggctaacaattagaacaacgtttttataattaattagaaattctttcagtcatttaatcgctttaaaatcaaggtggttggtcggctcatccattattaaaatatcggggttgccaaaaagtgcttttgcaaggagaactttgactttatagccggattttaaatctgacatcttactatttcagtattttttgggaatttcaagagcagagagcaaaatttgggcatcattttccgcgcttcatcctcctaggagcccgaatttttcctcaagttcgccagcgcggttataatctgcttcagttgcatcaggatttgcataaatttgatctttttcttgttggatttggtataatttttggttccccattattacaacatcggtgacattgaattcatcaaactcaaaatgattctgtgatagaacagaaattctttggttttgtgagatatgaatagagcctgaacttggttcaataagtcctgctaaaattttcaaaaaagtggatttcccagcaccatttgcgccgataatgccataagtatttccttctgtaaattttaaatttacattttggaataaagttttatcagcaaagattttcgataattctctaacttctagcattttattttcctttaattctaattttttatggtataatattatacaataaaattgaaaaataactagtttaaattttcatctttttccatttatttattgtctcttattaaatttatcaaaaaagaaagtgaagtttaaaaaatatcgctctttttaattaaaaatcaaaatgttaaaaaaaaaatttagaaaaattttagctttattcttgccagttccacttgtttttttaacttcttattcttgttgaagttcacgaattaaatcaattagatcagcaattaatgaaaattttgggccagattttgaactaccagaaaaacagggagtttttaaaaaacaagatccaagatcatttgatctttatgtatccgaagttaatgcaatgcagttaaaatgatttttaaataagtcaagtttaattgacttatcccaggaagaaaaaaacaaaatttatgcttcaaaactcgcaagatattatgtttttgataacaaaaatcgaatattagcagatgaggataaatttaaggcagagcaggacattaaccctacctttttaaaaaaagtctttgaaaaagcagctaattcttactcaggagacaaaacaaataatcaaggagagtctaataaaaatagttttgagaaactagataattttaaaatttaccgcgagatttcaaaaatttttgattctaactggcgttttcttgaggttagacttataaaaccagggataattgtacctgataaaaaaaattatattttaataaatgcttataagatttattatacaaatcctgttgattttgaaaagaaaaatgaggcagaaaaaactgaaaatactgaaaatcaagcccaaaacaataaaaactggcgaattaaagctccaaatcaaaaaccagtcacgcttttacgacttcattgatataataaaaatttagaaaatccttttaaaattgagtttaattcaattgaaaatccaaattctgaatatgacttacaaatgataaatgatattgaccaacccgagtcaatagctgattttgactttaatttttcaaggataaattctaaaaatacctcagaaccacttgaaattttccattcagaaccatttattcgtctagtttcgcaaagttttgcaatcccttttgatggtgaaattacagattttgaagctgaggattttaaatttaaatacgtgtttaacgaaaaaaattaaattttttataattttatattaaatttactatttttcttcaatataataaaaaaaatttcagatttttccattatggtagaaaaaaacgtaaaaaattataattttttacgttaaaaataaaaaatagcaaaatttttaccaatttttattttttatggtatatttataattagtctttaaaaaacgaaagggtgaagatgcaagcaaaaaacaatttatctcaatttgtgaatatgattttttcttataaaatcaatttttttgcatttttatttttgaatattttttctagatctttctcaattaataaaattaagcaaattttgaataataaatcaattaactgtttgccgttttcgaatctaataattatataatttaaaaaaaatattagatgagaaacgggttaaaaaacccgtttttttattttaaatataaataacgaagaaaggaacaaaatgtctttaaaaaacgaagaaggccagcgtcttgggccaggttctaatatcctaaatttttcggtttcgaaaataaatccaaaaagtatcgattataatctcatttattcagttgtaaaacataaaaaaagtcggttttcttgacttaaatatataaactttgaatcttttgcatttcgattttttaagaaaattactaaaatttttcttgaatttgtaatagtagcttgaatagttgcaactttggttttcttgttaattgattctattcccggagatccaagttttcttgatggactaacagaggcccaaaaaacagcagaaaaacaactttatggactagatttaccacaagcacaacgttattttaattatttatgaaagtttatccattttgattttggaatttcttatagtttaaggccgcgtgttgaaattagtgattttatttggcaaagattttttacctcattttcaattggtattgtctcagttgttcttacaattctaatcggtgttcccctcggaattgctgttggtaaaaatccaggtaaatttttggataattttgcaacaatttggattgcggttttttcatcaattccgtcactagtttttgctttacttttattaatttttggccaaaagactggaattccttatatttttaatattcaggatttttctacttttgtccttccagcgattgcactttcaattggatcggtaattagttatgtccgttatattcggtttgagctaaataatgagctaaattcgatgcatgcaaagtttgcttatctaaaaaatttaacaagaaatcgttttgtttgaactcatgctcttaaagcttcgctttttccaattgcaacttttttcccaattgttgttcttggctcatttattggatcaatttttgttgaaaagatttttttaattaccggttcaggaggtattatgatcgatgcaattcagtcaaaagataataatatcattctttttttggtaatagtttattcacttttgacaataatttcctatactttaagagatataagttatgaattacttgatccgcgaattagaaggagagcaaaataatgacccattttccttcaattgagaaatatattgaccaaaacttaaaaccaaacccatttttacaacctttttcttataaaatgtggaaattgatggttgctcaggccaaaaactttgatcgaaattattttggtaaacctcggaataatttctatgaagtttttttaagattttcacgttcattttccggagtttttggtcttgttactattggatttatgctaattttagcactaattattccatttacaaccggatcgccgacagaattacgtcctaatatgaaaaatattaactattttagtcaaggatttattcttggaactgactcacaaggtcgcgatgtttgggcatttttatggcacgggctgcgtttttcgttaattttaagttttattgttgctctttttgatgtagccttagggactttatttgggaccttaatgggaaattttgatctttttgataaaatttttacttttattattaagataatttctaatatcccaacaatcttagtaattattttgatgactttggttcttcggccaagtttttgagttctaattttgtctttttcacttacagggtgaattggacttgcaaatcaagttcgagcccaaattaaaagagcaagaaattttacttgggtgattgcctctagagttttaggtaccccttcttataaaattctttataattttgtcccggtaattattccgcttttaattacaaatatcgtttttgtaattcctggaacaattcttggtgaaactggacttgcatttattggactttcacttccaaatgttgctactttaggtaatgcaattaatgcgggaattccaattgtaactttatatccccgttatgttttaattcctgcatttttcttaattttacttacctcttcaattcaaatgattggaaattcagttcaggatgccctaaggaggcaaagataaaatgatttcgtatttttattcaaaatcagcaccgcagtgtcttaaaactgaaaatcccagattttgttataaactaaataaaaatttagtaaaatttcaaaaagaattagatctattaaaacagaaaaaacttgcaccaaaagaatatgaaagccagtttagtgatctaaaagaaaaatttttagcttatgaagttaatataaaaaaacattatcaggcaaaaaaatcctataaattacgtgctatttgagatcggattcaaaaatattgacatacaagctttaacagatcccattttgattttgaagcattttctaaaaatgttgaatataaacaaataggaaataaacgtcataaaattgttgcccagatcaaaaatttaaacctttcctttgtcaatccagcaaatcccgagattagaaatatcgtgattcgtaatgcctcaattgatttttatgaaggcgaaattcatgccttaattggcgagtctggttcaggaaaatcagtaattacttcttgtctttatggtcttgtcggtcaaaacggggtaattgaatcaggtgaaatcaaactttttaacaatccagtgcaaaattttgattttcgtgcttgagaactttcaaattatcggggaaaagttatttcagctgtcttccagaatccgatgtcaactttaaatccaacaaaaaaaataggcatccaaattatggaaggaatgttattaaacaagattgttaaaacgaaaaaagaagcctatgaaaaagcacttttatatcttagaatgaccaaaattgctaacccggaaatggttatgaaattatatccccatgagctttcaggaggtatgattcaaagaattgtgatctcagcaattttatcacttgaacctaaaattatcgttatggatgaaccaacaacagctttggatacaaccgtgcaagctttagttcttgatattatccgcgatctccaaaaaagactaaaaattacaattattttcattactcacgaccttggagttgtcgcttctcttgcaacttatatctcaattatgtatgctggtcaagttgtcgaggaaggtacaagagatgaaattcttttaaatccaagacatccatatacttgagggctaattacttcaatgcctgatgtcaataaaggcgaacgacttcagtcaattcgcggggttgttccttcttctttaaattcaattgttggcgatgcttttgcagttagaaacgattatgccttagaacaagatttttttattgaacctaaattttacagaataagtccaactcaccgagtcaaatcagctttacttgatccaaaagcaccaaaagttgtcccaccaaaaattatttaccaaaaatgactgcaatttgcaaagatgaggcaagaaaatggaagataaaaaaagattttacctagaaaaaaatagttatttttttggcaagatagtaaaaaatatttaccgcgcccttacacccggtattgaaaaaatgcttgaatttaaaggcaaatcaccaattgtcagctttcgaaatgttgatattacctatggaagtggttcaagaaaaaacaaagtaattcatgatattagttttaatatttatgaaggtgaagttctatcctttgttggtgaatctggttctggaaaatcaacaacaggttcagcacttgcgggtttagttccccgtagttttggtcaaattgtaattaacggatttgagctaccaaaaaatatccggaaaataaaggcaaaaattcttggaaaactagtctcaaatgtgcaaatgatttttcaagatccattatcttcattaaatccttataaaaatatttatgatgtaattacagaaggtcttgtaaatttagaacaacgccaaaaaggttcaacgaaaattttattttcacaacattattaccaaaatacatttgaatctttagtttctgcccttaaaaagcaaaaaatttctccagaaattatccagcaaattaataataatttctataaaaatacaaaggacattcctgttgaaaatttgtttaaaactctaataaattaccttgaaaaactaagagttatcgagactaaaattattgactatattcaaaaaaagtctttatttttacaggattttttaaaaaaaccactaaaagatattacctataaatatgttattgacatgttagcctctgttggacttgatagctcagttttatcccgttatccacttgaattctcagggggtcaacaacaaagaattggaatttgccgggctttattattaagaccaaaaattcttgttgccgatgaaccaatttcagctcttgatgtttcaattcaagcacaaattattaatatttttaaggatttaaaagaaaaatataacctgacaatcttttttatttcccatgatctacgaatggttgaatatatctctgatcgaattgcggtaatttatcggggaagaattttagaaattgggccttcaaaggaaataattaaaaattttttgcatccttatacaaaatcattaattgaatcaattccaacaattgaatcaaaacgaggatcgcttgctggttatgtctatgatccaaaaatacatcaatatgatgaaaaaaatcaacctcaatgaattaatttaggaaataatcactatattttagcaacttttgccgaactaaaaaggtgaaaattaggagactataattatgaaaaaatctaatattttgcttagttatttattagcaggcggaattcttgctggggcttcagccggaattatgggtggaattaaaatctattcagaaaataatgaactaggtgtctatgatattgatgtccaatcagatgaaaaagttgatattaaagatgatcaactagtctatgcaaattttaaaaatgcccagggccaaacagttgctgcttttgagaatctaaaagatccaaaaacaattttacttgatcctaaagtaaaatctgaaaaaagacggtttaatgaagtcgaatttgccgattggtttgccgataattataatcggcaaacaccaatttttgaactaaaaattggatcaatgcgttttgttaatgaatattgagattcacttttaccttcagaatttatcaaatatgcccaatgatttaacaaaaatgttgcttgaggaccagatgcaattactcttgaacattttgccttaaaaaaaggggttacaagatctgggaataatttattattaggacaacatgcaactgaaagaaaagaagtgacaaaaattgagttctatcctgattcattttttggttcttttccaatttattcagcccttactggaaaaggaaatagcgatgataatctaacttataaaatttttcataatccaatttcaaaagaatcacttgataagtattttgaatcaattccaactcagcaagttttagcaaattatgataaatccaaagtaagtgccggaattccggcaattgatttagtcgaaaatgaagatatttatttttatgatttagtaaaaattcttaaaaaatcttttccacaaaacaaagagattcaagataaattagccaaaattacaaatgaggaaaatttttttgtctttgccgatccaaagcaaaatcttgatcaagtcaagaaaaaatttgaattagcaattctaatgcttgccgatgaaaaggatatccaattaccgcagaattttcaacttattttcccagaagattttacaaaaactcggaaaattaagtgaattcgaagcgcattatctcccttcaatcaacaaataaaacatgatgcaaataatattccccaaggtgtttttttacttaaacttgaagatttaatgtcagaaaatccttctaaacaaccaaaagatcttcaaaatcaagcacaaaaaccaacacaaactagtgatcaaggaaaaaaaccacaagttcagcaaccaaatcaaagccaagctcaaacaaaagatttccgcttttcaataaatcagcaaatgaaagcgaatcgtgttgccctcatagttggggaattaacaacgaaaattcaccaaaaagctgaaaaaattgcaaaagaagggttttttgatctttataatattaatcatcctgttggaaaaataattgcaatttaccaaaatagtccagaaaatcgcttatttttgccagttgattccaaaaatccagccttagaagccgaaaatgaatttataacccaatttgatgcaagtaaattttccacctatgaaataaaaacagcaaaaaaattatcaaattataaattagaaattgaacttgttgaccaaaaagataaaaagtcaattaaaaaaattatttttgaccttgatccaaaaggtaaaaattatcaaagtcaacttgaagaatttagtagttttaaaattgcaattgactggaaaaaccgggcaattccaagagttattcaggaaattgaaactttaaaagacggtaaatcaacaactgtttatcaactttatgctgaagtttttgatggactaattgataaagttctaaaccatcgaaaaactaatggtgaaaaacttgtcggaacttatattatatcagaagttgatccaaaaacaggactaaaaacctatcaaacaaaacaaggtagttttattggatattcccaatcatcccgaattccttatatttcccttttaaaagcctcctcgccattttttaaaactacgggaattaactaccttaaatatgtaggcgctcatgaatatggtcatcaccaaacactaaattatgcccaggatatttccgatccagattcaagtattattcttgatgcgatctcaacaaataccgggattggtttgcaatctttttataatttagatgttctaagaaaatatctccatgcacgttcttcgggtctagacttaagaaaagcagggccgagtttagaagcgcaaaaaaatggaatttatccaaattttacttttaatcgcgataataaatttgaaagtgaagtcgatatttatggatcaaatgaaaatgatgaggttgattcattattaactaataaatctcggcgttttttgcagacaattgatggtctaaaaaccgcggctgacttaagaaagttaaaattatacgatcttttccttttaaattcaattgatccagaatctgcaactattaatccttcaattaaagattcagcaaaattttttagaaatgactggcagacaatcgaggatcaaagtaaaaaaggatttataaattctactgaatccaaaagtttatttggaaattcattaacagatgcagcaggaaacttacttgaatttgatgaaaaaggtaaattaatcgttgccgaatttaaggaatctgaggataaaagaaccttcagtgatcttaaagtaaaagtgttttttgcaaatggaagaccagcaattgattcgacaatttttacaaaaccaaacagccttagtgaattaaaagcaaaaattgctgagattcaaaaagcattttctgataatgttgtttctaacttcgacaataatggctgagatacaaaagccgaaggattctcccgttttcttccttctaatcctttttttgctaaatcacttagtgcaattttagcaaataatgccgaaaaagaagcattttatgggacaaaaattgccgataatccatctaaattagaaattagtgttgaacttcctagttcagtttttgatcctagtcaaattcttagtattgtaaaaaggtatataaaagatgaagaagcaattaaattaggtgaaaaattagttcaagatagtaaaggcaaattagattttcctacttttctttcaattttaaataaagaagaacttactaatggtaattcttcagcaataaccaaattatttgaaaaaatttttctaactccgataacagagaaaaaagatttatataccgatcttagaaatatcacctatttccgtgattctttagttggaaaaattgatttagctgttgaatttattcaaaatatttataatatttattttgaatgactccaaaatcaaagcctcgggataaatcaggccctaaatactccaaaaccaaatactaccccggatagaaaagctcttgttttaaaaagttactgaaactttgtagtttctgaccagatttggaataatttagacaaaatttttattatcaaaggtgaaaaaaatcctgaaaaaataccttctcggtttttttctgcaatccgaaatttccatcgattaacaccgaatgtttatgataaaaattttgttaacttaacacagggggcagttttcgcttcaagtcaccttggaaaattaatttcaattaatggaaatgaatattatcaaaatccaaaatatgactttcttgctacagttacaagtgggggaaaaaattatcttgtccttgatcattcagaatttgatgtaaaaattcgatctttaatgcgaagatgaatttcgccacttgggaatttgcttaaatttgataaggttttacttgaggataaaaatacaaatccgaaattaaatccattttttggaattgctcaggattttaaatttaaaataggtccagatcaaaaaattgatacttcaaaaatttatttagatgcctgggataaaacgctttttggttttgattataataataattattttggatttcaaaatgaacaaaaagaaactgtattttcaagtatttctgattttattgagtttatctcaattgatcctttcgcccttagagtaacaaaaaatggcgaagattttatccgaaattgaagtcttgattatgtaaattctaaatttgatttatatagatatgcttttgataggcttcaaaaagaaaaatttgttctaaaatctagcacaaataatcaacttacctggaaaaaggagctaaaatctacagaaattattggaaaacttttagctaattttgaaattagctctgaaaaattattagaaaatttacaaaaatatgcaaattttctaatggaagctttcgataaatcaacgcttaatttgttacttaaaaattctaaaattgaaaacaaaaatattgatcctttatttttatcttcaattggatttatgggatttaaaaattatgcccgtaaagttgatgaaaattcattaccagcaacaaaatttggtaaattaacaaatcttgatagaattaaaacacctgagacaacttggttgactttttcaactttcctaaaagaaaattcacttgttttcgataatgaagattttgttaatgatgatcttaataattcaaataaatcacttgtatataaatggattttaaatttcttagaggataaaaaaattgaatttaaagatcttgatttatttagattacaatatctagtcggaacaaaaacctttgctgattatacacaggaagatggtcttattaaacaaatccaaagaatggatgtcgatcttggactttcttggctaagatcgaaaaatttagcaagatttgaaactcgtgccgatgatttcttctctaattatgtctattctttccctgaatctctaactcgtgattttgtccaaattcattattcgccaagtaccgaggaacttgataatatctccccattatttaaaaaaatgacggaagcaaatactggaaatgagtattttgttgatggaatttatacaagaaaatgaataaaaaatttcattccggcctttgatatttcccaggcctatgcccaaaatttaatttcccggtttagcaatttcttccttacaagttttgtaataacaagaaacaacgagaatcttgaaaaattatatcaaaatttactaaaagcatttaaaaatgcccaaagtaaaaatttatatcaaaaattcaatgacttatccagtcagcaagaagctgaaattaagaaaattattggatctcaagaaattccgtctaaattcattgataaagttctccaagaaattgaaaacgtagacaaaatcaatgagatctccagtaaaatcaataggcaaaaagccgatcttttcagcgaactaacaattgaagttaaccgaattatgcaagattatcaaggcgaacttggaaattataaaaattatcataatcttaatattcagccagttgtcggaaataaaacctgaataaacggctatattaataaaaatgtcttaacaaataacgggtttttcaaagatcgtttccaaagaaaagtacttaattgagaattatatgatgataatttagagtcggtaaaagatccaaatattcgaattaaaaatctaaatggagaaaaagtcgataatcgtgccgaggcattttggtattattctcttaaaactcaaggtgtaggccaaagatcagtttcgggaatctggcgggattcaaaacatgataaggttgctttttggggattctttaaatctcaagatgcaaataaggcccattttctaacattagaagatgaatctactggtcaaaaattctacattcaactagctacaaaagggacaaacaatattttttatctaaaaaaacaagcagatcttagctctaaatgaacgcttgaaaatgaaggttataaatcctgagtttcagcttggtcaattattggggagtttaaaaatgcccttttaagacccggtgtttctggaattaaaagatttagaatttatttctctgatcaaaaaagacaagaaattaaaggattatttactttaggtaatacaaaattcatcgccgaaaatggaaaaaactatcaaacagcaccaacttatattgaaaaaaccgcaaaaggtaactatttggtaataaggccacaatttaaataaagggaaaatcatgaaaaaaataaaaaaacttttaattttaaacactttttttccaatttcgctgctttcattagtttcttgtaaaagcgcccttgaaaaaaatcggcaagattttgactttggtgttgcaactccgacagttaatacactaaattatataaagaataattcagctcatgatattttaaattcacttgttgaatcatttgtaaaacctgggccttcggcttctaaatcttatggagcaaaactaaatctgcccggaatttcttttgaattatataaaacaagtcttccttcttcaagtggaaatgaaattatggaaaatcctgctttgatctcaacagctgcatcttcttatcaaattagtgattttggaatgactgcgggggtagtttctccttcaaatggcggaggtaaatcctttattggaattcagaatgagagtcaatcaattgtttcaacaacaatttttttaaatcaaggggcctcaaaatgatcaaataaacaacctgtggttgcccaaaattttattgattatattctttatgtgctaaatattaatgttgcctccccaaatttagttaaaactttatcgctaaatatcaaaaatgcccaacaaattaactcgcttcaacaagattatgtctcaaaatttggaagtccttatcgtaatccttttggtcaaaaaagttataaaaaagatgcaaaaactgggaaagtcagtcttgattttgaccaaaaagttttccagtcacaaaataaaggtgatcaagattttgtcgatcaatttcagaaacttgcaagtggctttggaatgtatacaggtcaaatttttgagcagatgacaaataaagaagtagtcgaacttgttcaggcaaacttatcactaaatccagattttaactataaatccaaagaaatttatgtaattgaaaatggtaaaaaaactacgataaaacttacaagaaatccatttttagatccaagccaagtttttgatggcccaaatttagtcccaagatatgattttttacctggtgatgaatatggacttcgaatccaatttgaagactcaggtgccaaaaaatttattaatttattccagcaaattatcagacctgaatccctaagaccgattaatcgtgaatttgttgagattaatgccgggggaattgataattttggaactgatctttcaaaatttatgacaaatggcccctttgatatcaccgagatcaactggggttcccaaggttcaatgattcttgaaaaaaatcaaagttattattcggctgataaaacaattccaagtaaaattaaaatattttttgccgaacagcccgaacttctttcttcactttttttagatgggtatatcgccaaaacaaaaattccaactacttttcaatcaaaattttgatctgaaaacaaaacaagacagtatatgcaaaaattaaccggttatgggacgattggaattcaactaaaccttgataatgttaaaaaaggacagtcctgattacaagatccagatcttagaagagcaattttatatgggattaatagggttgatcttttgaatttatacggccttgatcattcttttgcccaaactacttggtcaaattttgacgggattctaaccgctcggggttatccacttgagactttcttaggagatcgaaaatataaatctgagtttaaaggaaaagatggtaaagagcttgaatttcctgttttagcccagaattataaaaaacatttagcaaaaagtgtatgatttgaggctgttccaagaaaagatgaaatttataatcctcaagttgcaaagtttttccttgatcggtttaggaaaaaatacccaaaagttgctaaggttagtctaaattttatttataaagatgataatgaagaaaaagttgccactggtcttcaagatattctttcgccaaatacaaataattttatccagattgaaccagtaagacttcctgatgggatttatcaacaacggattgctaaaggtgaatttgattttacaatgaaaaattttgactttttcaacatcggaagtgcccaaccccattcttatattaaagctttttttaattctgatgagatttctccccgcgataataagttttccggacttgagtcaaatccagccgcttcacttacttattggaaaatgtggaactcacttacaaaagaggagaaaaatgctttagtaaaaaggcttgaaatttctcctatttatcttgcaaaatttgaggagttaattacaagaaaaattaagctagataatcaaaaaaatccgatttttaaagaggtttttctaaataaagaactaaaagacaaagcactagatattaatcaaaagccaattttaataccggaatatgaagaaagtcttgatcaatataatgctcggattgatgctttttttaatggtctttttagtgaacaagagaaaaaagagggttggacccaaaataaggtttttgattttatagttatttttgaaaaaattatccgcgaatttgttccaattatcccaattatggaggttgatacttactgaattattaaccgaattcgtgcaggcgatagtaactctttccaatttgcatttgatgttgaaaacatcaaagttaattatctaagtcctgaagatggtaaagaatagaagctaattttagtctctgaatttaaaaaagtactataaatttatagtacttttttatttttgaggttaaaaatttagcatataaaagatttaaatttcaggtttgggaaaaaatatagccatagattttctaaaataattataaaccgaattagtagaatttctcataagttggtaagaaatcttgtataaaaagtttcttgtaaaaataactaccactaacgtaaaacaaaaatatggtataaaaagaagaaataagccaagacctttaagggaatttttatcagattttgttgccatagcaaatctagtaaaccatcctttttcgattatattcggaatagtttcaataagaattgttaataagacaaaaaaagtaaataagataaaaaaagaacaaattcgagaataaaaaattcgtaaatgaactttatataggaattgttttttgtcgttttcgaattgaatttcgtccggatttaattcaatttcacgaataatcatattaaatcgattaagaaatagaggggaaaacggaggtttgataacaaaattatagtattttgtatcaaattcattatttgatagaattaatgcttcacgtttgtattttctaataaatcatcaacctttaaataaaagataagataaaggaaaaataattaaaaaatatacaacaagtcggaaccatataatagttttatctataggaattttggaactaataaaaataagagcgagtaatgagcctaatcccacaataaaaataaagctaaatattttaaaggttgtatttaggaataaacaataaaaaaataaactaactgatttcataaaacaaattagtaacttaatacttcatccattgctctttggattctatttattcaatcctggatagtgagaggttgatattcagtaaatgaacttcttttttacgtgatttttgttttttttatttttgattttgctcaaaaaattatcttcaattatggcaaataaattttttaatttattttttagattttcctcataaggttgagcaacaacaacattacccaagctcaaaaggttatttaattctaaatttttcattttaataattcctaaattcacgatataattacattttgccataaataacaagaaattgaaatatttttttagatagtttagcaaattattcaatgttttactataaaaatttcagaataataaatattttatccaattaatttttttctattaaacctaatgttttaaataaaaaacattatttctggaatttttttattatttaataggaaaagtgaaaagatttatgaatatttaaaaaatttaaaattatgtatttttcgaataaaaaaatgaaaattagtttaccaaatattaaattaattcaaaataataatgaaaatttaataaacgttatccagggaagttttgcgctaaatttttatggcttaattaatagaataccaaaagatttgagtttattaattttttttaataatttttaaatcatcaataagaaaaatataatttttaaatcaaaaatttcagcatcttgaaatttggaaataattgaaataaataaatatttcacctttttgaaaattttaagaattttagatttaaaatataaaataaatcaacaactaaatgataaagaaattttaatttattcgaatgaaaacaaggaatttatctttagtactttatataaattagttgtacttttaacctttatttagtaaaaaatactttaaatttaagtattttttaatttgttttaaatctggcaagattgacaagtttcataattttctgaatcctcaaggacatcttgacgaattcttacatagtaaattgacttacaattttttttaaaagcataaatataagctcgatttaagtctcgagtagtcgccttgtcggtcataaataaggtcatcgagattgcttgatcaacatgtttttgtgcttctgagacaatgtttataatcggaattggacctaattcataagctccgttttgataaaatttgtatgttttaggacttaatttatatgaaggaacataaattctccctaattttccttcttttcttatctcaactggggcaacaacgggctgaagcgaaggcgtgcaggaactaagataggaaattgagcctgtaggagcaatcgccattagatgtgagttggcaattcctgtttttttaattttttcaacaagatgaattcaatctttttgagtcggaatttcaacttgatattttgcaaaaagttctttaattttatgtgtttttggtacaaaagtattcggggaaacttttgtatatttatcaaaatattctcctgatgcaaatttggttttttcaaatccagaaaaaggaccatatttttttgcaagtttttcagaggctttaaaagctgaaaaagctaaagtatagaaaaaaatgttagtaaaatcaagcgcttcctctgagtcataaaaaatttcatttttagccaaaaacccgtgtaaattcatcgccccaaggccaattgcatgatttaaattatttcctttttggattgaaggcgctactgagagatcagaatttcgcgagacaacatcaagagctaacactgaataataaaccatttcttcaaaatcagggcctgattccatcgccttatcaatatttagcgatcctaaattacaacaaatatccttgcctatttctttaaaacttagatcgggtaaaaatgtgcttggagttgaaggctgtgtgatttcgctacataaatttgacatcacaacgcgatcaggatgagcattttctttattgacaatatcttcaaataaaatataaggataaccactttcaaaatgtagctcggcaataattttaaataactttcttgccgaaataaatgtttttttaatttctggatttgctagcatttgataatatttttcactaatagaaatatcactaaaagctttttgatatactttttcaacatcatagacagaaaaaagcgccattttttcattattttttgctaattcaaaagtaatattcggaattattatcccaagagaaagcgattttatcctgattttttcatcagcattttcccttttggtatctaaaaaagccagaatatccggatggtggacatttaaataaacagccccagcaccttgacgttgtcctaactggtttgcataagaaaatgaatcttcaagaattttcattaccggaattacaccagttgcttgattttcaatgtttttaatcggggcaccttgttcgcgcaaatttgaaagtaaaacactaacaccaccgccacgttttgaaagttggagtgaggtagtaattgccctggaaattgattccatattatcttcaactcggattaaataacaagagacaaattcacctctgtttaattttccggcatttaaaaatgtcggggttgccggttgaaatcgacctaacataatttgttcaagaattttttcagctttttgaaaatctccttttcctaaaaataaactatttagtaaaactcgatcgggaaaatgttcaaaatatactaaattatcattagattttagtccataagttgaataaaatttaaaagcccccataaaagaagaaaaaaaatgattataacttcaagcttttgtatttaatttctcaagttcttggaatgaatattgtcctaaaactttcggatcataataattattttgaactaaaaattcaattctttccttaaaagaattgaaaaatttaaattttggattaatttcttcattaatatatttctctgctgctaataaatcaaatttatgtgaatcaggatgatttgcaaaaattttgctatttgcatttaagctaagataacttttttcctgatttttatcaaaattcagatccaaacccacttttttcatttattttctcccaatttagttagcgaactaactattatattcattattttttagcttattttcctcaaaaatcttctaaaatttgccgaaccttttttacatcatcatttgttcctaataattcaaaactatataaaaaaggaacttttaatttttgggaaataattgtgcctgcaagcgcaaaagtatcgccaaaattagtgtttccagaagcgattacagctttacaaaatcgacgattttgttcattgtttaaaaattttattacctgttttgggacagccccacttcttagaccttttccgccactataagttggacaaaaaagtacataatctttatcaactactaattcttggtcaatctcaacaggaattcttgctttttcaaagtttaatttttcgacaaaccgatgggtattattcgaaattgaggaaaaataaacaacaaaaatttctcctcttaatttagatttgtttattatatcatatttttcatcatttgtcattttaaaactcccaatcttcatcttcggtttcttcagcaagcgccattacataagaagagccatttcctgaaaaaaagtcatgattttcatcagctcgagccgataattgactaaaaatttcaggttcaatttcggtttcctcttttgaaaaaggtgaatcatatcctagattttgcaagaatttcccggcattataaatgctaaattttattgctgattcagcaagtccaacttcagaatataaatcatagagataatctttttctaattcaattagtttatataatagatcaaaggtaaattttttaatttcgtcttgtttttccgggcttaatttttccacttttttttgaaatttataacctgaataataattatgaatcactttatcgcgtaaaatcagtcgaataatatcggatgtatttggcagttttgaacgcgctgaaagataaaaaggaagataaaaaccaccatataagagaaaaccaggcattaaagcagcagcaacttttgattttaaaggatcttcacctacataaaaaggtataagaattctggcccttttttgcaatttttcgttattgattacccagttatgcgcctcttctatttcttcacttgagcaaagggtagaaaaaattgaaccataagaacgagcatgaaccccaaccataaaagcgaaatttgtataaattacctgttcatgatcagttaaagagtgtttaatttgggctacatcaccgattgttgcctgaattgtatcaagtaaagtaagtccggtaaaagtgcgagtaactactttttttcaggtaggtgataaagttcttcaggattcaagatcatttgaaagcggaattttttctggaattcagaaattttgcactattcgggttcaaacttcaagatcttttggatcatttatgatatttcagttgattgatcgcatttttcctgaaaaattattaagcgcatattcgagtggcgaaactgattgatggtagtagtcgttttttatttttaatttattattattactattactatttaattttgaattaatcatatttagctctttttagtgtcttgggccttaattttaccaaaaaatcaaaaatatttttttgtattttttggtaaacggtaaattaaaaaattgattttttacctaaaaatcctatgaatttatagacttttttaggtttaaaataataaaataaaggataaataaaaaggttaaaaaaataattaataatattttttatacattttaaacgattttttgaaaaaaaatttaatttattcatatattttgaaaaagttaaaatatatgaataaaaataagtaaaattccttatttttttggaaattttattaatattttattgctttatgttataatgaaatcagatttaattaggccggaggtttgaaaatgcatagaacaagaacgaggaacatcttaaattgaattaaagtaaaaataatcaattgatgatgaacttctgttataaaaattgatgagtcagtagttctaattttaaaagttttacagcttttcattcttgaatttagtcattaaagttagaaattttattcattttatataaaggttaattttattaacctttttttgttttttcagaataagaaataaaaataattttatatttataaaccataagttaaaaaaataacataatttatagacttttttaacgtttaaggtcagtaactttttttaatcgggaaatttttagttaaaattttaacttttttcttaatttctttaatttcaagcgcatttagctctttttttctcagaacaaaatcaattatttctgccatttgactaaattcctgttccttaaagccccgcgaagtcatcgccggggttcccaaacgtaatcccgaagttacaaatggacttaaagtatcatttggaattgtgtttttattggtgataatattaacagattcaagtaaaatttgcgcctgtttgccatttagattataagaactaagaacgtcgatggtaaaaaggtgattttcggtaccctgagatacaattcttattcctttttttataaattcactagcaaaatgcgatgcatttttaacaatttgggcacaatattctttaaatcaaggttctaaagcttctttaaaagcaacagctttcgccgcaattgtatgaaaaaaaggcccgccttgaattcccggaaagacaactttatcaatttttgcagcaatttctttactgttagttaaaatcaggccgcctcttggtcctctcaaagttttctgggttgttgaggttattatatgggcatatccaaccggcgaaggatgttggcctgcagcaataagcccggcaatatgagcaatatcagcaagtaaaaacgcatttactttatcagcgatttgtcgaaagcgagcaaaatcaatttttcttgaatatgctgaataaccacaaataattaaattcggctttgtttttaaggctattttttcgattgcgtcataatcaagaagttcattttcatctaaaaaataactaattcctgaataaaacattcctgaaaaattgattttatatccatgacttaaatgcccaccagcatttaagtcaagtccaagaattttatccccgggctttaaaagtgctgcaaaaacagcggcgtttgcacttgatccagaataaggttgaacatttgcatactcaatcttaaaaagtttttttactctttcaattgcgattttttcaatttgatcgataaaagtacagccaccataataccttttccccggataaccttcaccatatttgttactaggacttgttccatttgccaaaattacgtcttctgaggcataattttcacttgcaattaactcgatttggctattctgtcttttagattctaaattaatcagctcagaaatttgttggtctctaagtttgattttcttatacattggaattttatacattatacactaaaaaaccaaaaaaaaataatttttttaatttttttataaaaagcctttaaaacacgttacttttttgtttgaaaacaaaaaagctaacaacggtatcggtgtattgaaaaaattcttttttaggttttttagttcaagttttaagaattattaaaaaattgatttaaaaagaaaaaaaacaaaaattgttgaataaaaaccaaaatttttgaaattttgccgaaaatcaggttagtaaatttttggtttaaaaatttttgaaagcaaatttgagaaaaaaacaagaaaaacaagaaaaccaagaaaaatcaaaaaaagaagaaaaaaaactagataatacaaaaaaattaataaaaaataaaaaaaattattttttatgttaaaattataatcgtagggttaaaaattgataatttttaataacccacacaataaaacttaaaaaaaacatatcatatttatatttttgtaaaggagataaatgaattttaaaagaaattacattcaatctttttatgccaatgaatttcattcagaagaaaatccaaaaactttggatatattttccccacatgatggttctgtactggctaaattagagatcacttcaacttcaactttagacaaaattgtagctcaggcaaaaacagcccaagaaaaatgggcatctttaacttttaagaaaagatcagaagttatttataaatatcgcgaattagtaattcgctataagcaggaattagcccatttaattcatattgataatggaaaaactttaaaagaagcagttgcagaggttgaaaaagtagttgaactaaccgaatttgcctgctcaattcctcaattagtcagcggtgaaacccaaatggttagccggggaattattgcccgcgaagaaagacgtcctgtgggagtttttggaattattgctccatttaactttccattaatggtgccaaattgatcaattccaaatgcaattgctttgggaaatgctgtgattttaaaaggctctgaactttgtgggctatcagcaagttttatggctgatctttgaaaacaagccggcctaccaagtggaatttttaatttagtaaatggccaatctgaaattgccaatgcaatgatcaatcatcctgaaattgatggaattacttttgtaggatcaacagagatcgcaaaattagttcataaaaatgcatctaatttaaacaaaagagtacttgctcttggaggagctaaaaatcatatttttgtacttaaagatgccccaattgaaactgcatcttcagaagttttagccgctgctcttggaatggctggccaaagatgtatggcagcatcggttgctttagtagttggtcaaaatgaagaatttattcaagccctaattgaaaaagcacgtaaatttaagttagattttgatcttccccctcttgtttctaaggcttctgttgataaattagttacttatctaaactgggcaaaagaacaaggagcaaaaattttagtaaatggaataacagattttctaatccctgaaaacaaaaaagaaggattctggtttggcccaacaattattgactgatcagagattcctgaaaaaatgggttctcaagaagtttttggtccgatcttagaaataattagaacaaaaaatctttctgaggcaattaaaattcaacaaaaatcaccttatggaaatgccgcttcggtctatacccagtcaggtcgagccgctgaagaaattattgctaaagttaagccgggaatgttaggtgtaaatattggtgttccagtaccccgtgagccatttagttttggtgggacaagatcttcaaaatttggttatggtgatattactggcaaatccagtattaatttctgaactaatttgattaaagttactacaaaatgaaacccggaagacaaacaggattgaatgtcataatgaaaaaagaatttgactttattctaatagggagaattactatcgattttaacccaacagactattataataatcttgaaaattcaagtttatttaaaaaatacatcggtggatcggcagctaatattgcaattgggcttagtcgtctaaaaaataaagttggtttttttggatcagttagtgatgatcaatttggaaattttgttcttaatgtttttgaaaacgaaaaaattgatatatctcgaattaaaaaaacaaaagatcataaattaggtctaacttttaccgagatgctctcagaagaaaaaagcacaattttgatgtatagggataatgttgctgatctccaaattgatgtatcagatattgatcttgactatattttaaggacaaaaattttagtaatttctgggacttcgcttgcaaaatcaccttcgcgagaagcagtactaaaagcactatttttagcaaaaaacaacggtattaaagtggtttttgatattgactaccgtccttattcctgaaaaaatttagatgaagttagtctttattatcaaatagttgcccaaaattctgatttaattattggttcttatgaggaaattcaattaacatcaagattttgccttgaaaatccggaaaatttaattgatgatgactatgcaaaatattgactaaaatttgttgatcttattattatcaaaaacgggaaaaaaggttcaaaactttatcaaaaagataaaaaacttgttgctaaaatcgttccggttaaaatgttaaaaggttatggcggcggcgatgcttatgcttctttattccttgatcattatctaaaaaatgaatctgatcttgaaaatgggcttgcacttgcaacttcagcagcttcaattatggtgcagtcacattcatcctttgatctcccagattatcaaaaaatacttgaatttaaagacaatgcgctaaaatccgatccggatttggttcaaaaaaaggagtgaaatgcatttaaaaaatagaaatttaggtccgggttttcaccgcttagttgatcggaaaaaacaagaaaaagctagttttatgaacatcgaccttgatctttgaaatgcattaataaatgaagaattagactatcaagttgggccacaagatgaatgtgcgattttattaatcaatggagaagccgatttttatctagattcagaaaaaattagtatggcaagaagtaatatttttgaacaaagaggtaaacttttactattaaaagcaggccaaaaaattcaaatttttactaaaaaaccaagtaaattcctttttattataacagaaaattctaaattagatcaaaattatttctatgatgaatcaaattcaagggaagaattttttggttctaatcaatgagagcaagttgctagaagaaaagtaagaactttttttgactattattcaaatccaaaatcgaatttagtagtaggcgaggtggttacttatcaaggaaaatggtcatcttatttgccacattatcatccacagccagaaatgtattttttccagtttgaaagagattcagcttttggcctttcagttaatggtgatcaagcctatattgtcaaaaatgatgatgtaaacgctatccaagctggcctagttcatccagtttcggccgctcctggttatccactttattattgttgaattattcgccatttagaaaataatccttgaactgatcggatcgaagctcaagaacatctctgactaaatcaagaaaatccaaattattgaaaggaaaaagatgaaatttaaagtcggaatcatcggcggaggaagaattggctatgtccatactcacgcaattaataaatttgttgatcaggctaaagtaattgcaatcgctgatgcttatttagacagccaaaatcaggaaaaatttaggaaattaggagtaaaaagtttttatagtgactataatcaattacttttagatccagaaattgatattatttatatttgtagtccaactgatacgcactatctttattcaattcaagcactcaaagctaataaacacgttttttgtgaaaaaccagtggcttttgatcttgaaaaaattcttgaagttaaaaaagttgtaaaagaaacgaaaaaatatttcaccgttggacataatcgaagatttgatcataattttttagcactaaaagatcaaattgaaaaaaatacaatcggtgaaattatccagttaagaattacttcccgcgatccaggacttcctccatatgaatatatcaaaaaatccggtggaatttttcttgatatgatgattcatgactttgacatggcactttttctaactaataataaggtagttgaatctgtctatgcaacaggttcagctttaattgataaaaaaattagcgaattagatgatattgataccgccgttgttgttctaaatttcaaagacggttcaatggcaacaatcgaaaactgtcgtcagacaagttatggatatgaccaaagagttgaaatccacggaacaaaagcgagtatcaaaattgaaaatgatacaaattcaaccttgagaatttcttcagatcagggaataattaaggaaaaaccgctttattttttccttgaaagatatcagaatgcctacattcaagaaaataaagacttttttgaggcaatttcttctaataaggagccaaaagtaacaattgatgatggttataaagcggttttacttgcaaaagctgcaaaaatatctctaaaagaaaaacgattagtgaaaataagtgagttagaggaataatggcaaagacaattcgactaacaaccgcacaggcaattattaaatttattgataatgtttatctaaaaattgatgcaaaaacaaccaaatttgtctatggaatagctactattttcggtcatggaaacgttttaggattaggcgaagcgcttgcaaatattgaccatagtctaaaattaattcagggcaaaaatgaacaaggaatggctcatcttgcccttggttttacaaagcaaaaacatcgcagacaaattattgcttgtacctcctcagttggtccaggcgctgcaaatatgttaacagcagccggaactgcaactgctaataatcttccattattactttttccaggcgatacttttgcctcaagaagacccgatcctgtgcttcaacagatcgaacaaatccatgatttaaatatcactacaaatgatgcttttaaacctttttcgaaattctgagatcgaattaatcgtcctgaacaaattattaattcgctaattcatgcttttgatattctcactgatcctgcaaataccggaacagtaacaatttgccttccacaagatgttcaagccgaagtctatgatttccctgaatgattttttgagaaaagagtctatgaaatcaaaaggataaaagctgatcgcaaagatatagaaaaattagttgatctaatcaaaaatgcccagcaacctttggtgatcatcggtggcggtattcgttattcccaggcaagtagtcaacttcttgaatttctaagaaaaacaaaaattccttttagtttgacccaggccggaaaaagttcaattccttcatctttaaagcaaaatttaggcggaattggtgtaacaggaactcttattgctaatttatatgctaaaaaagccgatttaatcattggtctaggaacaaaatattctgattttactaccggctcaaaaacccaatttgctaaagaagccaaatttgttaatattaatattaaatcttttgatgcccggaaaatgaatggactagcaattattgccgaccttaaagttgcccttgaaagtctaaattacttacttagaaatacacaagaatttggatatattaaaaagatcaaagaaaataaagaacttttaaaggcaaaaacccaatgagaagactatcttaaaaagatctatgaacttgaaaaaccacttgaaaacaaagcgcttgtccttgataaaaatcaaaactcacctgaaaaattcgccttagcaattaaggagcattaccaaaaagatattcatatttttagccaaagtcgcgctttgtatctaatcaggaaatatattgatcctaaagcttcaattaccgctgcagcgggttcacttcctggggatctccaaagactttgagagacagatgaatttggatcttataatgttgaatatggctattcttgcatgggacacgagattcaagcagcaattggttcatcaattgcccttggttttaaaccaacttatgcccttgttggcgatggatcttttctgatgcttcatagcgaaatgcttacggcaattcaggagcaaattccagttgtgattatcctctttgataattccggttttggatgtattaataatttgcaagttggatcaaatattagatcttttgagactgaattttatacaagatcacagaaaaatctaaatgaatatggttctctagtgattaccgaatttgccacaattgcaaaaggttatggatttagatctgtttttgccaggtcagaacaggaatttattatggccctaaaacagtcaaaaagaacgaaaaaaccaatgttaattgagatcaaagtttatcctaaatcaatgactcctggctttgaatctttctgacaaaccggcctttcacttgtatctaaaaataaagaaattgaagaacttgccaaagaaaatgaaaaaatccttaaggagaataacaattttaactaatgaataaaatctgaaaactaaaaaatgttaaagtcggtgtcgctccaattttatgaacaaatgatgatatgcctgaattaggaggtgatatttcttttgatcaggcaatttcagagatggcagaagccggttatcagggcaccgaaattggcaataaattcccaaaagatgaaaaaattttactcagggaactaaaaaaatataatcttgaaatcgcttctgcttgatttagtggatatattatatcagattttgagaaaaattttcaagattttcaaaaacattgcttatttttaaaggccttaggagcgaaagttgttgtttttagcgagcaaacttattcaattcaaggtcaaaataaaccactttttaaagataaaccttattttacaaatcaagaatttgaaaatcttgcccagggtcttaataaatttggtaaatgatcaaaacagcacggaattgagctagtttatcaccatcatatgggaacaggaattcagtctcttaaagaaacagaaaaaattcttgaactaactgaccctgaatttgtcagtctgatttttgatactggtcattttgctcatgctggcgaagatattgttttttgtcttaaaagattaatctcccgaataagacatattcatctaaaagatataagaaaagaaaaaattaatgaactaaaaacgaaaaatttaagttttcttgaaggagtaaaacaaggaattttcactgttccaggcgatggtgatattaaaaattatcctttatttttcgagcttttagccaaaaataactatcaaggctggctaattgttgaagccgaacaagacccgcgaaaagcaaatccacttgaatatgccaaaaaagcaatggattatctaagatcactaatttcatgatagggaggtaaatattgaattctatccaaaaacatccattattttttaaacttgagaaaatcaatttaagttttggccctgttaaagttctaaaaaatatgaatttagaactttataaaggcgcagcagtcgccctaattggcgaaaatggggcgggaaaatcaagtctgatgaaagttttaagtggggtttatcaacctgattcagggaaaatgaacttttgtagtgataatatttgcaatcaaaaagttgaattttccggggtaattaattcccaaaaacaaggaattgccattattcaccaagagcaaaatttagttgaaagcctaagtgtttcccagaacattttcctgggacgggaatttcggaattcctttggacttttagattataaaaaacaagatgaagaagcaaaaaaacttttagatactttaggggctgaatttagtccaaaagcacttgtttcttcgctttcgatctcacaaaagcaatttatcgaaatcgccaaagctttatcccaaaaaccggaaattatcatttttgatgaaccgacttcggttctaaccgaaaaagatacccaaaaactttatctgcttgttgaaaaacttaaaaaacaaggaattgcaatcgtctgaattacccatagaatggaagaaattaagaaaacttgtgaatttatcactgtgattcgaaacggaatgtatattgaaagtaagccaataaatgaatttaaaaacgaagatgagattatttctttaatggtcggttttgatatcgagcagcgctatcccgaaaaaacgccggttagaagtaaaaaaccatcgtttttagttagaaatttatcaaatgataaagtttctaatatcagttttgaaatcaaaccaggtgaaattttagttttttatggccttgtaagttcaggtcgaactgaattagctagaactttaattggcgatatgccttatttaaatggtcatattgaactaaatggtcaagaatttcgcccaaaaaatattaaggacagtcttgatcatggaatttattatctttctgaaaataggaaacaaattggtctaaatgttaatttaccaattaattttaatatcacaatttcttctcttggctcaaatcagattttttctttccttccttttgtctcaaaagcaaaaataactaaaactacaaatcattatattaaacaattaaagatcaaaacaacttcacaagatacgccattaacttctttatcaggtggaaatcaacaaaaagtttcacttgcaaaagggcttgcaacccaaccgcaagttttcatcctcgatgaaccaactcgcggagtcgatgttggcgcaagaaaggaaatttataatttaattcaccaattaaaacaagaaaataaaacaattatgataatttcttcggatatgcaagaggttatcggaatcgctgatcgggtaattacaatgtatgaaggcagaattacaagtgaattagttggcccgcaaattaccgatcaaaatataatgaaatattcacttaatttatagaaaggaaattagatggtaaaagtctgtagcaaattgaaaaaagaacatcattttgagtttgtcgattcacttgattttttctcccgggaagcaaaaattgccgagataagaagctattataaaaaaagaatcgaatttaaccaagaaaaattagatacagcaatttatgcttgacatgatgatttttttaaccttaaagtctcaactgatgatcgaaaggattttattgaaaaaaaagcccaaaaacaaattagacttgctcaaaaagccttagaaaatcttgagaatcaatatctaaatttagctctcgatcaagcaagttttgaatcccaaaaaattcatctacaaaagcagattgatcaacaaattaaagaaattaaaactaaggccgaagctaaaaaacgtaaagcggatgaatttttagaaaaacagcgagttaaatacgaaaaagagatcgctaaaaaagaagctctccataaaaattttatggattatattcatcaagattccaagaatcaaatcaataaaataagcaaacaatttcagcaaattggtgaaaccgatccaagtttttttagctcaagacaagaaaaacttgcccaagatctaagagttcttaatcgtcatacaaaagcaaaattagaaactttagaaactgatttttctctacgaaaaattggaaaaaatacttttttagatcagaagaaaaatattgaattatcctatctaaaagaagtaaaaatgctgcaaaaacaagcacaaatggttcatccaaaaatgagaatggctacaaaaatctgaaactttttaaaattcagagaacaagatcggttcattaacaatgttgaaagagccaaaaaatccttaaataatacaaaattattaattttgtttttaattatcgcctttattaccggagctttaaatgttaatttttttagttcttataactgatttgttgcgattttaaaaaataatatttttattggatttatcgccttaggtcaaactttagtgattctaactggtggaattgatctttcagttgggtctctaattggttttggcgccacgatttacctgcttttaacagttaaattaggacttcattttgttgctgtcttatttattttgatcattattttagctgcaataggaattttaaatggaattttgatctcaaaatttaaaattccaccttttattgtcactcttgccggacttttatcacttcgaggggcaattgcgattttattaaaagggacaccgatcactaatgctcaagatccaatttttaacttttttaactataatttaggctctaatttctcggttttggttcttgtatttattatcaccgttgcagttttaatcttttttattaagttttcaaaatttggaagatatgtctatgctgttggtgataatccagttgcagctacattttcagggattaaaaataataaaattttaattttagtttatatgttttccggaatctttgcgattttaggtgccctttcaatctcatctgggacaacttcggtatctcctaataccggttatggttttgaacttgatactgtaaccgccgttgttttagggggaacagctcttactggtggaaaaggaggggttggaaaaacgattattggatggtttgcaatggctttattattaaataccttctcatttttccaattagactctaacttccagttagtcgcaaaaggaattattattgtccttgcaattctttttgatcaaaaatatcatatcaatgaaagattatccaaactttattacaaagttttagtaaaaatttagaaaggaaaaatttaaaacttttatgtccaaattatttattagaacattatattgagtacttgggcttatcgctgcgattgcaatttattttggaaccgcttttgggatagcttcaaggtcgaatacaactgccaaagttgccccagttgctgttgttttttcaacaagaaataatccttttttccaaaatgttgaaaaagggattgaaacagcagcaaaagaattaggagttgactatgaagtctatgactctgaaaatgactcggataaagaagcaagaaatatttcaaatattattgcaaaacaacaaaaagttgtaatttttaacgatgttaatgaagattcaggaatctcagctgttaaaaaattaaatcaagctggaattccggtaattgccactgatcatttactaaattcgccaaaagccttagaagcaaaaattaaagttgaagccaatattgcttctgataataaacaagcaggagtaattcttgcccagtttatggcccaaaaaattggacttcctcaagattcacttacttattcagtctatggaattcccggaactgaatcaggtgaatcccgggcacaagggtttattgaaacagttaaaaatctaaataatcaagcaataaaatacaaccttttttcctatggaaaatatggaaaagaaaatgcaaatggaaaaacttacatcggaagacaagctgatgataatcgcgatctagcaaatcaaagagttgcaaatgatgcaacgcaagtattccaagatgctcaaaaaaggccacttttggtttttgggactaatgatgaagctgccttaggttcaatttctgcccttgaaagtgcccagattccattaggaggtggagataaattccttccaggttcaggaaaagtttatattaccggagttgattatacaaatgatgctcaaaaagcggtattaaataataaattatcagcaactgttgaacaagatactgatcttttaggaagactttctttaataattgcagaaaaaattcttaaagatcaatgaaaaacaagtaaatattctgatttttattcacaatttcctcagcttgataaagataaaaatcctgatgatcaagttgagcaaggatattattttaaagtaggaacaaaacttttctggaaaggaccagatggaaaaggcgaaaaacttcaagccgatgaaaatgggatactccaaaaggtaaattaatctataaaaacaaggataatttatgaaaaaagcaaaaattaaagtcggtgttttaggactaggacgaatgggtctaagccatgctgaaaaccttttagataaaatccaaaatgctgaattaatcgcactttgttcccttgatgagacagcaaaaaattatgctaaattatgaaatattcctttttggtataattcttatgaaaaaatgcttgaaaatcaagaaattgatgctgttattattgtaagtcctaccccttatcatccccagaatattcttgatgcccttagagcaaaaaaacatgttttttgcgaaaaaccattaggaacaaatcttgaagaaatttataatttagtaaaattagcaaaaaactatcaaaatcaagtaattcaaatcggctttatgcgtcgttatgataaagattttcactatgcaaaacaattagtagaccaaaatcagatcggtaaagttttttatgtaagaactctttcccaagatccagaaaaagatattaaaaatatgttttattttggaccaacctctggtggtcaatttattgatgtaggcgctcatgatcttgatttgatgatttggtatttaaattcttatccaaaacgagtttgatcacttggtgatgcttataaatatcaagaatttcgcacttgaaatgatggcgatgtggttgcggccatgtttgaatttcataatggatcaattggaataatgacagcaagccggattggccctcaaggttatcaagcccaagcggaactaattggaacaactggccatctaaatattggcctaattgatgcaaaaaataacgtaattagtctaaattctgctggcgcagttcataattaccaccggaattttaactcccgttttaaggatgcttatattgctgaactaaatgattttgtcaataaaatcattgaaaaaaattatgataaaacgcaactagatgaggcattagtaaatataattgcacttaaaaaagcacaagaatcatttcaagataagcaaattaaggaaataaattatccagactggcttgaaattaaataattaaaaaaataaaaataacaaaaaattagaagttaaatacttctaattttttttatattttatccaaattttttctttaattttaattaaaatttaagaaaaaatttgatttatttccaaaatcagaattttgccatcgatcttgaaaatattcctcagcccgttgatcaattactaatatccctgtcaagatcaaatggtcttataattccttctccttttttgattgcaagatataaactatttttaaattcttcattttcttcaaaattatcaactttctcaaattcagcaaaaccgatagcaaaaaccttataaaaaataataaaatattcccttaggtaattaaaacgaagaaatcagaagggaactgcggcaaaagaaagtagtgttcaagtgataattaaagtgccaattccggcatattcaatcaatatatcataatcatttctgatatttttgaaaaatgaaaattgaaaacccattttaaaaatagtaacagtagccgctgatcaaaaaagtgttaaaaaaatataagataaagtagataaaacaaataaattattatggattttttttacttcctcaaaataatttaacttgtaatcccgtaatttaaaatcattggcaaaaatatcaatttctaataaattgtatttgtatttagaaataaaatttgacattttatttaaaaaaaatttactgaatataatcgtgttattataaaattggtcaaattttgagattttttccccgttttcttccttaaaatctcgaaattcaattcagaatttattttcaattagaaaattagttttaataaattcggtttcaaaatggagagataagccttttaaaaaaagatgattttgtcgatacttttttttgctttccaatccaaatcagataagtaaaactagtaaaattatacaaaaaacaagcaaaaatatcaaaaatgtattaattaccaataatctatcattaacatttttgataaattttgaattttttttaataaaaggttttatatcaaattctaataataaaattgaggttagcaagataaaaaatacaagaaaaaacagcgaaaaaatcaaaaaaattgacttatttttcctgatttttcaattaaaaaaaagaactcatttctcaatttcttttttttgcattttttatttgctttcttgaagttctgctgaaattaccattgtagttacaaccgagacaattgagtttaaagtatcgagaatatttagcgctgcacttatcggatttacataaccaacactcattaaaagtccgcgttttgccgcggttttaattgtaagttgttttattattttataggcattcttaatccattttagaaatatagttttttttattaataatttagcaattgtttcttttgtaatttcatcgcttatttttctgccaataatttttatgattgttttttccattattttttctatttgttgtttgattaatattcgtattggatttgttgctgtagaaagatttgcaatattataataaaaacctaaatccataccacgctctgtaatttcttctcttaattgatccttaaattcataaaatgacattcccgaaaattttatgattctttcatattcagaggagtttttaaattgatttattttttctcaatcttcatccatttctttctggattttaaaagattctcatacaaaatatgtcattattgatgcttgtatcgaagcagctgcggcaagcggagcggttgctccaaaagttcaaaaagccaaacctgtataagttgcaacaagtgctcaagctgtccccgctaaaactgcagatgttatatttagcccttttgttgcattataaaatctttgatatttacctaaaaatttctcaaattgcttctttgattcctttgtttcattttgtaattttaaaaatttttcttcccactctgaatcatttagtattgcatcaattattttttttcttcattttttgttaattttttagcagtattgctcttttcagatagattattagaatttttttggctttttggtttgcttctattcatttcctcttttattaaatcgttttcataattgttttcttgaatttctggtgtttgagtattaacaagtggtaaatttgaatgctgaaaatataaattaagagcatctgttgatgttattctttttgactttatcgcttctaagttctcataaaattcttttttaaatcttattctttgttcaatatcattaaaattatccaggttaaaatttaaatattcttctacttcactaaattttgaaaaatctacatcttctattaattcttgcatttttgtaaaatttttatcaaatctttctaacatagaaatactttcaatgttatcagccaaaattttaataggcggtgtagtatcaattggttttgaaattatcagaggatttctactttgataaatatccatatttctaacttgatagacagggacaaaaatccctggaagttgagataaatcacctaaattaaatagaattttcttcatgaatcacctcattatttataatttttgctaattgatcaagctgataaaatttcttgtcaatttcaagttttaatactttaattatatttgaaaaagtggacttttcaaccaaaactttaaaaatatttaaaggtctattcggatttaaaaaatagaatttttcctgtttttcctttaaaaacttaaattttacttgttctaaaagttttttattttcaccattgataaattttgagtcaataattaaaaaattttcattttcataattttggaaattagtaactattcgcgcgtattttagataaaaaactaaattttttgttgtggttatcttaaaatgtgactcaagagtaactgcatcaaaaataaaatctattttgctttcatctttttcctttaaattctcggctgtttctaaattaggatttaataaaaactcttttattaatttaatatcttcgttagtcggggcaaactcaattttttttatactttcaaattgaaaatccatttcaaaaatcatttttttcattattcacttattaaaatctagaacaaattttttttctggatttaatcggcaaaaaataatactagtaaatccaaaaatgaaaaatgtaataaaacaagcaacaccggtgtataataacggcaaaatatcaggatttattcgttttgtttgtatataagattttagggaacccagcataataatcaaagtaattgttaaaaaaacacaagttaatgagaaaaaaatagtccaaaaaatttttaaaacaaagtatattttatctaatttcttagttaaaaacttttgatcctgtcaccgataccggcttatattcatagaatatttcattaaaatttctttgattattcggctattcttatcttctagcataacatataaaactactttaaaataatattattttatcatattagttaatttttatgaatttttaattttaaaattagcctttaatttatagtgttttttcatttttagtatttctttttaatcaaaaatagtaaaattcatctttagtcacgcttttatggtaattttattatatttaaatatatttttgcacaataatataaaaaacatattaaattattaaatcattaaaaaaatattaaaatatacccaattattttttaaaaacatccaaaaaatggtcaaactttaaagaaatatggaaggaattttttaataagtttttcggatttcataatttttttcactaattaaaattctaactaatttatattaaaaaatttataagaaaagcttgaaaattttgaaaaatttgataatatttttgttaattagctttcttctaaccttttcgtcaaaaaaaccataaaaatacttattcatattattaaaatatgatataattgtaaactcgagaaaggaaaagcatgaaattaggtactttttttgctaagttgttttcgcttaatagttgaaagcgcttttttcttgcttttttgacttttgcgcttcttggaagtgggatttttttggtttcaaatttttatatttctaaaaatattaatcgttcaattgaatatggtggtggggctgaagttttagttcaagttaaaactttagatggaaaaattccatcatctaaagttgtaaaagaagctgatgcagcaatttttcaacgcctaactggaggagctaatcttagtgggacaagcgttttcactgaaggcgaaggtcggattagaatttcccgtaataaaatttctaataatcgtgaattagacacttttattcaagaaattgttaataaaccagttttaaccattactgatgttgatacaaatccacttttttttgaaggaaaatttgataaaaaccttaaattagaccagggaaacgaaacaaattggattgttccttttgctccaggttctgcaatttcacaaccaaatccacaaaatccggcaaataatcaagtattaattgagctaaaagataaaaaagctcaacttgagtgatcaaaagcaacagagtatatttcaaaattaggtcatggtaagaatcgaattttgatttgatcaaatattgttgaattaaaaaagattgcaaaagaaaaattccctgcccaatgagcaaaatccggcgaaaatatttataattttgtccatgttggcgagaaaactacccctgaatttcttcagggcaataaaattttacaaccagaacttaaaaaatatcaatttgatgcgaaaaaatatttgatttccgatgcaaccgtttcccaagcgctaaatggaaaatcctttgtaattactggaagatttacccctcaagaagcaaaacaattggcccttgatataaattatggaacagctgattataaactagattttttatcagcatcttttgttagcaaaacaaaatcagattcagtttttattgcgggttgaattgcaattgggcttgcaattgcaataatttctttatttttgttaataaattacgggcttttaggtgcgcttgcaacaatttcgctttcattatatgtatttctaacattactttttttcacaattgtcagaggtgaatattcgccgattacaatttcagccttagttgtgggaattggaatgaatattgatgcaaatgttattagttttgaggtatttaaatcccgaatttattcaggaaattctgttttaaaagcaaattatcaagctaatcgattgtcttttaatgcaattcttgattcaaatattacaacactaattgcagcacttgttctgttcttttttggtactaaaaatgttaaaagtttctcgattactttgattttttcaattattttcactttaatagtaacaatcggctttacaaaattttttaccagctttattcttaaggcaaactttttccaaaataatgaaaaaaaactttgactattaggtatcaaaaaatattatcttagaaaatatcaacgcggttataattcaatttattcacaaattgattatgaaaaaatttataaatatacgagatgattgccgcttattttgtttttaggttcaataatagtttttgcagtttttgccggaatttatagatcatttggttcaggatttaatttagcaattgattttagtggcggaactaactttttaattgaaagctcaaattcaagttatgatttaattacaaaggaaaaagccgaaaaaataattagttttcttgattcacaaaatataaacaagtcaaattcaacaattttgcttaatccattaaatgaaaatggaaatatttttaatcttgaaattaaaacaaaacttgatctagcaacaaaaattgcctcattaaatacggcaatccagaataatttttctaatattcgaatgacaaattattcaatttcgaatgaagaagctcaaaaattaattttcaatgcaattctttcagttggaatcgcacttatttttgtaactatttttacgctaattaggtttaaatggactttttcgcttgcaataattttctcacttctttttaatgttttaatggttttgctagcaattattattacacggatcgaaatatcgcagaatttagttgttgcaattcttactttaattggttatacagtaaatgatacaatcgtggtttttgatagagtaaaagcaagattttcagaaataaatcatgaaaatgtttataaatttgataaaattaaagaaatttccttacaagcaattagagaaacagcaaaaaggtcggtatatacatccttgacaaccattttaacaattgttgttttaatgattttttatgaatcaattgatattgtctttagcctgacgatgttaattggtgtgataattggaacatattcctccttatttatcgcaacccgcatttggattattcttgaatcataccgtaatcgtaaaaaagagatgagaatcaataaaaaatactgaaatgtccaaaaaatttatgaacaaactttcgcaaatattaatgattatgaaaaataatataaatcaactttttctattgtggggaaaatcaaaaatgttgatttttttctaatattttatttgataacttaaaaaaaggtaaaaagtgaaaaaaaagttaaatttatgcccaaaaggaacctatgatttctttggccaaggtgctaaaattttcattgatgttcgtaaagttttttttaatcaggcaaaaaaatttaatttttcttatattgaaacaccaatttttgaatatgcaaatatttttctaacaacaaatcaaatcgcagatattgtaagtaaagaattatataaattttttgataaatcaggacgtgaattggcactaagacctgaaggtacagccccaattatgcgctcggtagcccagcataaattattccaaacagaaaagaaatttttctattttggcccaatgtttcgctatgaaaaccctcaaaaaggtcgatttcgtcagttttatcaagccggatttgaaattattaattataaaaaagattcactggaattccaaattcttgaaattattcttttaattaaatcgatttttaaagaccttgggataaatgaatatgaacttaaaattaatttcctttcgaatctaacaacaaggaatatttatgaaaaaaatttggcccaatattttgaaaaattcagtgataaacttgagccaatttcaaaaatacggattaagaaaaatccactacggattcttgatgataaaattgaacaggaaaaagaatttgtcaaattagctcctaaaataaatactttttgaacaatggaagataaaaatatttttaatagaataacttcaattctggaagaatttaaaatcagctataaagttgattataatttagtccgtggtcttgattattatgatgattttgtttttgaatttattgatacttcacaaacacttgggacaaaattagcgcttgtaggagggggttgttataataatttgccgacaaaatttgggcttaataattttaaaagtattggaatggcctttggaattgaacgcttaattgagattctaaaatcaaaaaagaacataaaagagcaaaatcttgacttttttttattaagttttaccgataaagaaattttgctaaattttaaattagcaaaaatattacgaaaagaaaattttttagtcgatttaaataaaacaccattttcagtaagtaaaggttttcaattagccaaaaaatctggagctaaatttgtttttttctttgaaaaaaatcaagcaaaaaattatatttctctaaaaaatttgcaaactggaaagaatgaacaaattttatatactgaaattaattttgaatatctaaattcaattatcaaagcgagtgaaaatgcataattcgaaaactttatccaaatctgatctcggaaaaacagttacaattcaaggttgagtacaaaatattaggaaaattaaaggcaaaagtttcgtgataatccgtgattatcaaggaatttttcaagctgttgtaactcaaaattcaaaagttgatcgattcaccaaggaatctgttgtcaaagttcaaggaattcttactcagcggataaatccaaataccaaaattcataacggtgatcttgagattctagttgataatttagagacaatttcattagcggatcagattccttttgaaattagcgatcagctagaagtaagcgaggatttacgacttcaatttcgttatttggatctacgacgccaaataatgaaggaaaatttaacatttcgttataaaattttccattatattcgttgttttttatataaaaacaactttattgaaattgaaactccaattctttctaaatcaacaccagaaggtgctagatcatttttagttccaacacggcaaaaaggcaaatttttcgcacttccgcaatcaccacaaatttataaacagcttttaatggtttctgcttttgaaaaatacttccagtttgctcgtgtttttcgtgatgaagatctcagaaaagatcgtcaatttgaatttttacagcttgatttagaatttggatttcccacttttgaaaaaatttcagaggaaattgaagcactaatacgtgatttatgaacaaaaatttttcccaatttagcaatagatttcccaaaacttacttattttgaagcaattaagaactatggaactgacaaacctgatctccgttttgagactaaattatttgatttagactttcttaatgatatagacttgctttttcaaggaaaagttcgcggacttttccttgaaaaagttttaattacaaaaccagaatatcgaatttttgtcgaaaaaattcaacaaaataatgcaaaaacacttttatacctgcatatttttgagggaaaaattacttatttttcctttaaaactagtgaaaaactcttaataaaaactaaaattgagaactgaattttgcaaaataactaccacactggcacactatttctaattgctgctgattataagattgcttcgcaggcacttggagcacttagaaatttagtcgcaaaaaaatataaactgattaacgaggatcaatttaaatttgcctgaattattaactggccactttttgaattagatataaataacaaacttacctcagctcaccatccttttactgccccaactttagaaagtcaacaatttttgcataaaaatcctttaaaagtccaagctcaggcctatgatcttgttcttaatgggtttgaattaggctcagggtcaattcgaatccacaatgcggaattacaaaagcaagtttttacaattctcgggcttgatcaagaccaaattcatactcaatttggagcgctgttacgcgcatttaattacggcgttcctccccatggtggcttcgcttttggccttgatcggctcattatgattttaagaaaaacgaattcgatccgtgatgttattgcttttccggtgaattcaaaaggtttagacctattgcttgattcaccaactgaaattgaccaaaatttacttgctgaatttggtttgaaggatataggcaaaaactaaattagcaaaaaataagtaaaaattattttttttggtataatttagaatataattttataagtagttgggcaaaaatgatatatgataaactagaaaattttgataaatattcatttctaaataaaaattttgctaaattagctgtttttttaaaagaaaataatttaaatgaaattcctccgggaaaaactcaaattgatggtaataaaatatttgtaattaatgtcgatgttacaagttttgatgatacaaacgcgctttatgaatatcatagaagatatgcggatgttcatattgtccttgatgaagaagagcaatatttttttgatttttccgagaaattaataaataaaattagcgattattctgagaaggatgatgttgctttttatgcaaaagattcaactcgtaatttaataaaaccattaaaaggtgaatttttaatttttctgcctggagatgcgcatttaccaaaatatactggcaaaatcagcacaatccgcaaaatgattttcaaggtagaatattaaaaaggaacattttataaacattttagtttttttaaaaaacagtattttattgtataatttaatatataatagatattaactaaaattattttgtttttcaaaaaaaaaaaaaaaaaaaaccgaaaaaggaaaaaaaagaatggcaaatattaagtcaaaaattaagtcaattacaaaaatgcagaaggctcgcgcaaaaaataatgcaattaaatcccgtgtaaaaacagcgatcaaaaaagcgaaaattgccataagtactgatgcatctaataaatcagatttgatagcaaaagctcattcagaaatttcaaaagcaaaatcaaaaggtgtttttcataaaaataaagcaaacagaaagatttcaagactaaatctttttgcaaatacttacacaacaccagcccagtaattaaatttttttagtaattttattttttggttaaaaatttaaaaaatattaccaacaaggtaatcttttttaattcactaatagatgataatgacaactaaaaatgcaaaaagcattttattttatagtatttttagttaccaagtcttgatttttaaatattttaatgtttaaatttagcgataaatttattataaactcaaaaaccaagaaagccaaagccaagaatcataaaaataaaaagtgggattattcaatatcaggttgtttttttctgaaaaatattttttgtttgatcgcctttagctaaatttgaagcatttaaatttggtgaaaaatctgaattaaaaacagtgagctctttttttccaccaatttgtgaagtgccaggttccaaaatcaatgtggccttatctaagtttggattagctcgaaaattgttagcaatttgagctaagttttgaatataaagatattttttagcatcaatttcttctggtaaaagtagattatagacatgatcccttaatgcgttttcgagattttgactattttttgcaacagaaaaactaaattgcgttgcacgtatttgacctaaattatgaatttttggatttgttaagcttccgacaatattgactaatttaattgtttttccgccataaaattttttattagaatctggctttatttttagttctagatcccaaactttatgcggaatctgctcactttcttctatatttttaactactttttcaacaatttcatcgaaatttatgataataaaatcagcattaaatttatatttttccttagttcaacttttttcaatttcatcaagaatgaatttttttgctttttcaggattagaaactccagctaaatttattctgctaatatcaagtttttcaaagatattctgccattcttcaataatttcacttgtttctggcaattttctaagtaaaataaatggcttttgcagaaaaaaattgttcttaaattcatcttttaccttaaaattcgcaaaaatcttattatcttcttcttcaagaactatatcaactttatcaccattttcttgagaataaaaataattgataatttcggcataattatttgtatttttttcgccacttaacagattaattttgtcaagtttaaagtcaatttttgttttattttcatactggtctgtttcactaatatttatatttttaaaagtgaatttaccatcatttttacctaataatccattttttttctcatttttatttataatatttatttcaaaattaaaagttccatcttgattctcaataatattttcaatttttagctcattaccagcaatttcatcaatatcacggatcattatttttaataaatcagcctgcatttccggattaatttctaaaattgtattattttttccaagtttaaattttgaattttgtgaatttcctattatttttttctttttaatcgctgaaatgatccgattttttattaaattacttgagtctaatttagcattaatttttttaattgcttgttttttaactaaattctcaatgaaattacgccaataaagcaggattttttcataagataattttttaatatcatctcaggacattttttgcagcattaaattttgtgataaaatttgtcctacttttgattcccaaaacggaataattgctttatttggaaaaatttgactaaaaagttgggaatttgagttctcgccaatcgcaactattttatatgaagatgttcccttttcaaaatttgaactaaaaagtcaaattcctgaatttgaaaagtatttatttgtactatttgtaatatcaaatttttctgatttatgatcttttttgcttaaaagttcaaatttttcgtgattattagggttaattttatatctatatgatgaaattttttcattttcaactgcagaatttaaggttatattcgctccttttccactaacacttccttcagcaataaagccaaaatctgcattaaaacctgattttaaacgtgaaacctcacttggaagctgggcaaaattactattttctggcaaggaatcaaaattattgccagttgaaactcaaagaatttccttcttagtgccagtttccttatcaattaatgggtcaaatttagggttttttattttaaggcctaattgatcatatactagatttccagatgcatcttttagataaggttcaattaatttttgttgttctttattattttgtggatctcatgcaaaccacttaatatccattattgaattggccgctttgattacaaattcaatttcatagaccgctattattttggaattatcctgtgttttatcacttttttcaaatttttttatttcaactttgtacttatttattgcgttttttttatctttttggtctagtcttagatcttcaagttcataattgaaattacgatcaaggacatcaattggcttatcatttacatataatatttcattttctttttcatctgcaaaaaaatttaatttaattttatcatgatattcccattttccaccataaatatagtcaaaattttgctttctttccttattttttgcttttaatatttcaattggtttatcaatttttggtgtataatccttttgttcataaatttttccgggaattattgttagcctttctcaaaatttatcttgattttcaactatatttgttaaaaaattaatatttacattatcttttagtttaaaatcatagtaatttttatcgtctgggtgttggaaatgcagtaaaaattcgatttttgtatcacttttgatattaaatttcagtgatgaattatattttttttgatctttgaataataattttgaatactcttcggtttttttttgaatctctccaagtatttctgattttggatttagagaaaaattccgaattccattaccattttcatcattagtactaacaggtaaaataattttgttattattaagaacttcattatcaaatttttttcttagaccacctaaatattctttaagttcagtatttaattttaaaaccggtttttgatattgatagttaaatttaaaatttatcgcaaaatcctttatttcattttccattatttcaaaaccaattcgataaactatgtttgaaattcgaaaattattagctccaaaatttttttcaagtctactaaatttttcttttatgtctttattcaaactttctgatatatcaaattcgtattttatatttgtactttttctaattcctgcaactattagggaaattcgatcaaaaattgacttatcatattcaccataaagattaaaaattgtttcctgttttcagtttctaaattttttttcatctctataaaattgtcaattacgacaattttctaaattagggcaatattcaagtgcatatttttcttggctaatttcgggttttgaaccgggtaaataaattttatttgctatttgtttatcaaatcagtatgattctagtttacgaacttccttgcttttgttatagtttttatccttaattcactcaaaatatactgaatttgcatttctatcaacttcaaaatttctaattactgctgtaaaacttgcagattctgattttgtaactggatttactaattcattaatttcaaaataatcattatttttttgaaagctaattgataaaaaaggcaacggaattaccgcagcagttaaaaaaaatggtaatttttttatcattaattttcctccttatttgatttatctcctttatcaaaaaataattttttctccattttgttaaaataacctgagcaaatataacggtcatttaggtttgaagaaaaaataaattcgccaatttgagaaagagcaataaattttttctcttcattagtaagtccgcctgaggaagaaaaaagtttgtcaactttttcaatatcattgctctttaggttaaaaaagaaagcatattggcagttttcaataattgcctcagattttctagcagcttcaccactaattgcaaaatcacccggattttgcgtagtaattattaaagaaccgttgtatttccggatagtttttgcaattttgaataaaaaatcaagggcaattgtattggattcgtcaataaaacggtgtgcttcatcgacaattaatacaattttttggtttttatagaaattagttgcaatttttccttcaataaatgataaaacaagaaaaaaagcagattggtaaattcgtttttccaggtgcatcaaagtcgagacattaaaaattaccaatccacgtgagatatctaaatttgtactgtggccattaaataatcggtttaatttcccatattggttaaattcatagcgcaaagttgataaaataattgtcttttcaaagtcggtaatatagtcaaaatttaactcttgaaatttttggattaaatcagtaattgtagggaatttatctggttctaaaaggcaaacatcctcaaaaagtacataaaaaccgcggtttttatacatttcattaatagtttcaataactgccatgaccattttatgttctaaatttggtagtagaattccaaaaaatttttctaaattttgcaaatgaagggcaattgtttctgaattattaaaatcttctgcttcttcttgttttgattggggattgaaaaccttttggatttgcaagggattaaaaattgttagatctcctccaccaaaattaattcgatttgcatttaaattatcaccaatttttcaatattcattttgtggatctaaaacgattacggaattattgattgccttattatatgttagtaatttttttgtcatcgttgattttccagcccccgaagttcctaaaataaaacagtttgaattttttctgtcttgattttgccgaaaaagatcaaaaaaaaccggagtataatcagttttgctaattccgatgatattataatttccatcattaaaatttcgtgaggtaaacgggattccaaaagcaatattgctagccggcatttcaatttcttcttttaaaaaattactaaaacgaaaaaaaagtgatgcaaaaccttgcaattgtcggtattttaatggattgatagttgccccaatatttcttagattattccgattttgactttcaatttcttttagttgattttttgtctcagcggtgtttaaaaaaataaaagttgaatagaaaatttcttcccgtgatgagccagcaatgctgattatttcttcaagagcggcacgttctgtggctgtttttgttttttgaacaacatttttttggtcattaaggtttgattctaaattttttgcccctttattaaaactattttctttttcggtggcagttaggcgatttagatgccaaacaacgctactgtttgtcgaaaaaagttgggccgctcagccaagcggtaaattaaatggatattcattgatactttgaactgaaaaataaatatcattaatcttaaaattttctgggtatcattcaattttattttgagctaaatatttgctaatatcatcgccatttctgatgttattaaattcttcatcatttaaaaagtcgttaaaattaataatttttaaatttaaatcaagtagatcacgcaatggtgcaattcgtgcacgaaatccagtcgaagaaatatttgcacgcagaagacttacctgttgcaacaaggaaacatcatttttttcatagacaataataaaatagcggtgatgtaaatatgtatcaaaattagcaatgtcatttttatattccaagcataaattttctcctaaattttcaagacattcatcttgataccgtagaaaaaatagtttattttttgttaaatcattaggatgagcaatttttacaattgaaattcgattgcttattgcattaagactgacagttagttgctggagaatctgttcaattttttcagttccaatactgaaaatatcctgaccattaatctcaatccctcctacaaacccgccaccaactttgataaaatcctgttttgcacgcgtatatggtaataaatttccggtatttgcactagtttttgaagtttttgtataaatttttggccgcgaagtgtataaaattatatatcaaagaattttataacccttaagacctcaatttttatagtgttttattaacggaactgtaaaaataaagaataaagaggcagaaattaaaatttttcataaaataaaaatgtcttctggcaaagcaaaactgatgctagctgaaataaaaaacataatcataatgattggtaagtcaattaaagtgatttttcgaaaaatttgaatttggacatttttgattcgtttattctgtaatttcattagtttttccgttttttagctatttttttgcattatttatcttttttatcatcaataatttctgatttcatattgtcattttcaggtttaatttgtttttcaaggtcgttaatttctttaatttctgattcaatattttcttgattattttcagccttctttatatcaatgttattatcctgattttttagttctattttttctgtttgatttacagttttttgattatttgtagtcgaatctagttgattttcggtcacttttttcttttttccacgtggttttttctctttttcttcaactgttttaacctttttttctttttttggtcttttttctagttctacttttggagtttttttaacttttttagtcatcttttttgttggtttttcactagtttccaccacttttgtgcgaggttttcgtttagttttcttttcctcttcaggtaatttgcctcaaaatcattctcaaaatccttgtttttttggttctacaaccgcgttttcttctaatttttcagttttctcagttgataattcagttgtagtaattgttttttcagccgatttttcagcttcttcaactatttcattagtttctaaatcttctttttggtctaaaatttgtgtttcagatgtatttttaaggctattttcctttgttttttcagatttttcattattaactacacccacttcttccaatttttcttggttttcttcgtttatttgctccacttcagcactgttttggccactattttccaattttgtctccacagagttatttttttcgttggaattttcagtgatattttgcccagatttactattttttgctgtttttggtttatttttcactcttccctcttcttcagtctcactattagaactatcagattttttattttttctaaaaaatcgaccaatcttgtcgataaaaagtttcgttggaccgtttttgtgattaggatctaaggctctttttgctcgccaatttttgaattgttcatacttttttttagcatattttacgccctgatatcccattgctgaaccggtagcaagtgttgataaagcccccattattgatggtcctcgccaatttgttaattttgaattacccggggcaagcgagttatcaacaacattgaatggatttttatttttatttttttcaaacaaaccactaacatcaagtttatcatttttaccatttttatttagaaatcctaaaacaccggcagctccggcaattccaactgctccaacctttaatgttgatgaagcaagtctttgttggtgatcaactgctccttcttgaccaaattgtgaggcaatttggcgggtaaaggcagcgattgccaaaccaccaccgataataaaagaaattctgattaaaaatcgaaaaatttgcgaactagttacttgacttagatcaattaagtctgcaatttggtatgttgatccaacccaaattagaaacaaattaaaactaatttggtagacaataattattgcaaactgtcctagaaaatttttagttcaagtctttagtctgcggccatcatcccagatacttgtcattgctcagacaggcattgtcaaaaaattcataaaaagttgagccgatgaggtaaaccaagaaataaaacttatccctaaaatgtatgcaataacaagtgaggaagccgaaagtgtgataatcaaactaatcgcctcaccggattccattccggaaaaagttgaataactaggggaaccataattttctgagattcattttatttcttcttcaggaattttatcgcttgctgattttagcatcacagtaattaaattttgatcgccgcgaatgtgttgattaattaaaaaaagtgttgactgaattgtaataagtaaggcaaaaaaaatgattggaaaaaggaaaataaaagcaaaggaaccaaaaccaactcttcccattgcaattatttcactatcagctgacctttttcgaattattaaaaatttaatatatcgtagaataaaaacgataaatcccattgaaaccgatgtgatggcaaaaattcaaaagccaactggtaaattttcaaaagcaaaacttttcttttgaaaaattgcatttacaataacattaattccgatttgatcaaaaataaaattaaaaaacgcaataactgataaaggcagataaactagtaaatatcaacctagtgtaaaaaaagggtaagtaattaaactgactagaccactaaaaagtcagccaaacattagccttttgcccctgaagccgccgagctagcaactgagattattaccgttgaaagtccaagggcaactaaaatgattataaagccgattgaagaccaaattagggctttttttcatttatctcgtttttcaacatcatgtgaaattgctaacattgttgcaaaaaaaactacggatgcaacaagtatcccagcagcaatcggcattccgatctgtgttagatattttattcatttttgtaaagtggtagctaatgttgatagctctgcacccacttggacatcctcaaataaacttaaaatatacattattctcctctagtttgactctcataatagacatcttttatttcggtaattcaatttgcgccttgataaattagatcagaacaacctgtataatcgagttgatcttcatcatttttatcaaaaaagcaataaatttccttaccaaaatcaagaaaatagttaactaaattttgtgatccacctgatttccgaattgaatagacaactaaaaaattagcaagcgctgcaattaaacggttcctttcaattaatctttttttattaacattgcatcctgttggatattcagagataattaaaatatttttataatcctgaaaattctcaaaaggtcatggattttttatcccatttgccgaaacagcgataataggtgcttcatataatcggtaatattccattattttttgctcaacacctttataaccgtttgtaactaaaatatgacgcttgataatttgatctaatgatttgttaaaaaattcctgaattttactattatatttttcgccaataagcgcgctttttggatttttattttcaagaaattcaattttaccttgataaaatagaacataaggcggattttttagtacttgaaaggcttcaggatagttttcatctaatattgtaattgcttttatttttcctgaatcaagtttttcttgaagttttaaaaattcttcttttgttatttcctcttttgtttggatagcattctggattaatttataatctcctttatatttaatggcatagtaaattagactgctcttcatttcccttcctttcatttataaattaagaaaatttagtttttatttaataaaaaaaacttttaacataaaaagtttttttatgtcttttttttgaaatcaaataaaagaaattatttaaacttaagtttaagtcttatttaaaattaccctgtatttatcatacttatttttcataagaaactttaataaaaaaaataatttaatttttaaattatggtataattttttacattctaagttttttagtattaatttaagatttgaatgaataaaaaataaaatagagaggttattatgtcaaaaattactaaagtttttgctcgcgaaattttagattcccgcggaaatccaacaattcaagttgatgtttatactctagcaggtggatttggttcagcaattgttccatcaggagcatcgactggttcccgagaagcgcttgaattacgtgatacaaatacaaaatatgcagataattgatatggtcaaaaaggcgtaatgaccgctgtggataatgtaaataatataatagcaccggaaattattgggctttgttgtaaaaatcaaagattaatcgatcaaaaaatgattgaattagacgggactccaaataaagaaaaattaggtgctaatgcaattttaggggtttcacttgcagttgcaaaagctgcggcaaacgaattaagaatgccacttttccgttatttaggaggaaccaatccgactttaatgccagttccgatgcttaatgttataaatgggggcgaacatgcctcaaatacacttgattttcaagagtttatgataatgccacttggttttagaacttttaaagaggcattacaagcggcaaataaagtttttcataatttagcaaaacttcttaaaaaatcaggttttgaaacgcaagtaggcgatgaaggagggtttgcccctaactttaattcccacgaacaagcgcttgattttttagttgatgcgatcaaggaatccggatttaatcccggatttaaaggggaaaatgctgttgcaattgcaattgatgcagctgcttctgaattttataatgggcaaaaatatgtctttaagaaactaaagtctgcctctttaaataaaaaccaagcagatttagatgaaaaatttgaatttaattcagaggaattacttaattattatggtcaacttttagcaaaatatccaataatttcaatagaagatggatttgctgaatctgattgacagggttttatcgcctttaatcaaaaatatggtaataatcaccagattgtcggcgatgatttaactgttacaaatgtagaaatcctcaaaaaagctataaatttaaaagcaattaattcaattttaatcaaattaaaccaaataggaaccttaagtgaaacacttgatgcaattcatttagcacaaaaatctgggatgaccgctgtaatttcccatcgttcaggagaatctgaggatacaacaatcgccgatcttgcggttgcagtatcttcaggacaaattaaaacaggttcactttccagaacggatcggattgcaaagtataaccgacttttagtaatcgaggaatatctaaattcttatgcaaaagccgattatattggtagggaagttttttataacttaaaataatagtctaaattatgaatattcgtttaattttgaataataaatcctttgttgaaaaaaaactcgcgacccgcggttttgatatttcaataattaacgaattatatataaaaggtcaaaaaagaaatattttacgtcagaaaattgatgccttattagcaaaaaaaaacttaattagtaaagaaattggagctttttcaagacaagaaaaggattcaagttttcttaaaagccaagttagtaaaataaaaactgagatcgaaacccttgaagctgaatgatatcagcttgatacttgattaaatcaaaaaattttagaaattccaaatttacccgatgattcagtgccttttgggacttcagaacttgataatcaagtaatttcacattgaggaattccaaaaaaatttgatcaaaaatgtaaaccacattatgaattcgggatttctaataaaattttagactttaagcgagcagtaaaaatttccggtaatcgctttgtaatttataaaaatcttggagctaaattagtaaggtccttgattaattttatgattgatactcatattgcaaacgattatcaggaaattatcccaaatactttaattctctcggaatcactttatggtactggccaacttccgaaatttcataatgatttatacccattaaaggatccaaatcgctggctaattccgactgctgaggttccgttgactaattattttcgtgaagaaataattgatttagcaaaaccaatttcacttgttggttatagtaaatgttatcgttccgaggctggaagcggaggcagagacacaaaaggactaattcgccttcatgaatttcataaggttgaactagtaaaaatcacaaaagaagcagatggtttaactgaatttgaaaatgtagtaaaggatgcttcgcgaattttaaaattactggaaatcccatttcgtgttgtagttttatcaacttatgatttaggattttcatcaaaaaaaacagttgatcttgaagcctgactgccttcagaaaatacctatcgagaagtatcatcaattagttattgcggcgattttcaagcaagaagagcaaaaattcgttatcgtgatggtaaaaataaccattatgcacacacaattaatggttctggcttggcaattgatcgtctagtcgcaattttattagagcaatatcaaaatttagatggttcctgaacggtgccaaaagttttagaaccttattttcgctaattagctcttattttacaaaattaaaggacattatatcataaataaatttttaaattacagaaaagaatttaaaatttatttatttatttattttaagtttaaaggaagaataatgaaaaaattattagttattttgcttgataaattccaggatattgaacttacaacttttatttccctgattaaaaaagcagaaatttttacagatattgaattttttaaccctaaaaataaattagtaataggtcaattcggagttgtatcaattcaagcacataatcactggaaatcagatgactttgatgctgtttttattccggggggttttgcggcccaattattccgcaaggattcaaaatcaattcaacttgtgagcgagttttttgcgcaaaacaaacatatttttgccatttgtgatgcaccaaatgcaatttttgaactaaaattagcagaaaattatcaatttagttcatatccaaaccaacataattccaaaattagactaagacaagattcgttagtaactattgaccgcaattatatttcggcaagaaatgcagcaagttcggcagattttgctttcgttgtaattgaaaagctgggatcaaaagagttagctcaaaaaattagaaatggattttatctttaaatttatagtattttttcaatttcagcattaattaggtcacttttttcataaaaaattgcatggccagttttttcaaattttaccacctttttgccaaaagtagctccaactttttcaacacttcttaacgggacaaatttatccatttcagccccgattaaaaaatattcatttttttgctcataaagcggtaaaagcacatttttgtgtcaatctaaattaagaatttgatcaaaaaccatatctgaaaaaagttcctttttttcctcaacaagtttgaaaaaagcaatcgcacttttaaataaactagcctcagaattaggtttatccttataaaataaatttgtaactgtttcttttgcctcatataaatttcgtggtagaagtcagaagcctaatctttccatttgttttttaaagcttgaatcaaaaataaacgggtttaaaggtccggctaaaattgctttttcgacaagattttcttttagaatatgcagtccaatcgcggccccaagtgagtgggctacaacaatttttacttttaaatcaagtgtttttataaaatttacagcaattttttggtaattttcaacactaattttttgattattactacttttaccacagcctggaaaatcaaaggcaacaatatcatatttgcgttttttgttttgccgaagttgaaaagtaaaattatggcttgagttaaaaccatggagaaaaagtacttttggtcgattattatcttctaaaaagtagaaaatttcttcattgtcaattttaatttttcgatttactaccatttaaactccaaaaattgtatctaaaatttcataaggcagaatttgaccaaaatactcatttaaattatgaattttttctagttctctttcaagactatcacggtcaaattctttattttccaaaatttcttctatttcttcaattggcctttgtgataaaaaatcaccttcaaacttaatttttataattatatttttttcaatatttgctaagaccttcaaaattccggcacttgttcgtttgatattttcataactaaaaaatgggttggttccaaaaattcagttttttgattctcgtaattgacttatttccttgaatttttcagtatttgaaattcctatatcaaaatgattttcaacatcaactgattttgtttgatattttttttcaaaaaatgaaattaaacggtaaataaattcattatcatcaatttgctcttccatttcatagagaatgtttgttactcgttggcggacagatttaattccttttgattcaatttttagtcgacttggctttaaaacttgtgctaattttgctaaattagcattaaataaaattgttccatgatgaacaattttatttttaaaaattatctgggcattacctgaaacttttgcgccattgacaattaaatcatttcgtcccttaaattcagcttttagccctaaggatcgaaaaaattcgataattggtgatagaaatttttgataattatgattttgcttttgactaataaaggaaaaatttatattacctagatcatgatagaccgccccaccccctgaaagccgacggtagatttcaatattttcctcttcaacttcctcgagtttaatttcttcgtaaatattttgattttttccaataattatcgcatttttatgttggtagaagtaaagaatatcctcttggttttcttcatcttttagaataatttcttcacagactagtgtataaaacgggcttgtattttttgttgtataaattttcataattatctccaaaattttagttatattctaaattaaaagtcgtaattagtttaaattttgatttaaaatcggctagattttcgcctagtcgcaaattttctaaattaaaaatttgcactttttcataatcccagcgtaaagcatatccactttttgtcaaaaaaaagattaaatcttctacaaaccagaaaaaatagttcgaattatattctaatttatcatctacactcttaactgcgatttctaattgccgaaaatggtagtttagaactcggaattcaaaggataattttcaatttttactacattttttagcttcttgatttttttcctttaaaaatgaggttgacataatttttccttttatttataaaattaatgtttttattttattataatttataattataaactattaaagaattaattttatttataattaaatttattttataattttgaaagggttcttgtggaaataagaaaagattatattgctttctatcggaaatatcggccaaaaaaattttctgatattgtcggtcaaaaatttttgcttgaaagtttaaaaaatatcatcaaatcaggtaatttttttcatgcctaccttttttcaggacctcatggcactggaaagacaactgttgcaaaaatttttgcaaacgctataaattgcacccacaaaacggatttaattgaaccttgtcaaaactgcattaaaaattttaataattcacttgatattattgaaatggatgccgcatcgcataatggcgtgaaggaaattagagaaattatcgaaaattcaatcaattttccccaaattagcccctataaaatttatattttagatgaagttcatatgctttcaacttctgcttttaatgcttttttaaaaaccttagaagaaccaccaaaacatatgatttttattctagcaacaacagaagtccacaaaattcctttaacaattctctcccgtgtccaaaggtataattttctagcgctaaaagaagacgaaatttgtcaccgattagaatttattcttgaaaaagaaaaaataaaatacgaaaaaaatgctttaaaatcagtctttttattaagtcaaggtagtcttcgcgatgcaatttcaattctagagcaagtagcaacatttgggtcagggtatgttaatcaaaaaaatattaatgaactttttggtctagtaaataaggaaattcttgtcaattttgttaatgccttatttttagctgattctaaaatttcttatgaaattttagaacaaatttcatttcaaagtaaaaatttccaattatttttagaatcattaattaaccttgtaaaagaatgaattatttgaaagtcaaccaaaacaaatgaactacttgaattttatagcaattttgatttagaaaatctaaaaataagccaggattttgcttttaaatttttagaaattgcattttcaagtctaaaagatataaattttgctgatttccaaaatttaactcttgaaatttttattatgcgcatattatcgctaagtaatttagaaattagtgatcaaaataatattaaatttaaaaaattagaagaaaataaagtcgataaaagtgatatccccgaaaaaattactgagaaagttagtgagattaagtctagccctactaatttttataaaattgaggatcggcttgaaaagttaggaaaattggatctaaaaaatttagaagaagatatgcaaacaaagcaaaataaaaattattcatcaatttttaatcgaaaattagaacaaaatttggaaagaccacctttaaaaacagaggttttttccaaatcaacaactgaatttaaccaatttggacaaataggtaatccatttattgaaactgaaaatcataaaaaaattgaaaatcaaaatctgaaaaataacggtgaatttgatggtgaaattgatttttctaattcttttatgcctgaaaatggtaataaaattgatgaaaatataaattctgtgtctgattttagtgatatttcggctaatttatcagaagataagacaaattttgcccaatcctttaataacaaggatactaatttaataaatttagatacaaattttggtaataattctagtaaatttttaaaaaaaattggttcaaaagactatttgagtgctgaagaagttttgaattttatatgattaggtaaaaattttcgtagtcaaaatcaggtggaatatgaaaatttagttcaaaattgaagaaaaaatttgccacttttcgagtataatgttgaatttatggaaattgttagcgtgttaaaatatgctaaaattctctcattaggtgcaaattttgttttttttatggccgctcgtgatgaatatgaagatttattaattgaaactataaaggaaaaatatcaagtcaatgagttattattacaaatttttaacgtggaaatgcatccattagttgcaagcaaaaaccttattaataaagctaaaattttgcctaccaaaatgcggaatgagggcaaacgaattgttgcaaaaccttttgaaatccccaaaaaaacgactatttcaaaggaggatttggaaaaacttttgtttgataagtaaaatttctaataaatttatataatttattttgtaatttttaaaattatcgaaaggaccaattatgaattttcaaaaattattaaaacaagcacaaaaaatccaaaaagatcaaaaagttaaaaaaaatgcacttgcaaaaatggactttgactttgaaaatcaaggaatttcattaacaattaccggtgattttgaactaaaaaaaataaaaatttcaccaattttagtagataaagacgatattgaaacattagaagatttactatcaattacattaaatcaagcattattgaaaattaaagaagaaaacgaaaaaataagcgattatccaaatcaagtttaattatgatcaaagaaacatttaaaaatcttgctgaggatctaagaaaaatcccgggaatttccaaaaaacaagcaatgcgaattttgtcttttttggttgatgttccaattgaaaaaattgaaaattttgttagagcaatttatgatttaaaaaaaaacacacaatattgtgaaaaatgtgggtatttaaatactaatccagtttgtgaaatatgccttgatttccaacggtcttttaaaattttagtagttgaaaataccgaaatgattgctaaatttgaagaatatggaaaatatgatggtcaatattttgtttttggtaaatatgatattaaaaatttagaaaatcataatgcccaaattaaaaaattagctgatttagccgctaataaaagtgagataattcttggtttatcttcgacaatggagggactgatttttgcaaattatctcgcaaaacacgagtttttatccggccttaaaattactcggcttgcaactggaattccatttggagcaataattgattatatcgataatatcaccttagatcaagcgcttaaaaatcgacaagaaatggaaaaataaatatgtttattagttttgaaggaattgatgcaagcggaaaatcaaccgtgatggacttatttgcaaagtatttaaaaatcaaatttcccgaaaaagagattgttactacttttgaaccaggaggcaaaaatttaaaagaggcgctgcagatccgtgaatttttactaagtaagaataatcaaatcagcccttatgtagaaatgcttttatttgcaaccgcaagacgaattcatctagaaagactaatttggcccgcactaaaagcaggaaaaattgttctttgtgatcgctatattgattcctcgattgcctatcaaggttttggaaatggtcttgatattgatttagttactagtttaaatagtttgatatctgagaatacttttcctgatttgacaatttttttagatattaaaatttcaaaagcctttgaaagaatgggcatttttcgcgatcataatcgtgatcgcctggagaatagaggtgttgaattctatgaaaaggtgattaatggttatgaatttttggctaaaaaaaataaaaatttttttaaaattgatggaaatggtacttatgatgaagttttagacctcataattgatttttttgagaaatattatgcaagctgaccaaaataattgaagtagttttctttataatcttgataaaaacggtaaaattcctcatgccattttactaatttcaaattatcctaacttattagatagtaaaattaacgagtttcttgaaatttttgaacataaatacgaaattttcctatatgatattttcgataaaaatctttcaaagcaagaatttcttgaagatattaataaattatattttagcacttttgcagattctcagtcaaaaattttcatcctaaaaaatattgaaaaaacacatatatccttgttaaattcgcttttgaaaattcttgaagatccaccaaagtcaacttattttttattaattgccaagtcacaaaatttagttattccaacaattgtttcgcgttgtcaagttttttgatttactgaatttgaccgccaaaaagatcttaaaaaaaaattagatcagtggaaaaaaacgccatacaattcggtttatgcaaaaattttttcaaattttgaaactgcaattacttcaattgcgaaaattagtgaaaatgatttggtaaaatttgagtccttatttaataatctggctaaaaaaaaatttgaatttttaatttttctgaataacattttaacaaaagaaaatgcgctgattttggttaaaatgttaattttttattctaaatcaatttttttgaataaaccgaaaaaaaattcaaaaaattcaagaaaagaaacatttatgccagaaaatttcaaaaaaataactaaagtaatgcagtcctcacacaaatttttaactaccttagatcagaacgaaaattttaatgttcaaaaatccgcatttttagtacggttgaacattattttataaaaaatgtcagcaaaaattactgttttagccaccccaattggaaatttaaaggacatcagtctccgcggaattgaggccttacgtgaagccgaactaattttatgcgaggattcacgggtttcgcgaaaattattaaattttttagaaatttatgataaaaaacttatttcttatcataaatttaacgaaaattctgttatttcaaaaatttcgccgttaattttttcgggaaagaaggtcttattaatttcagatgcaggttctcccttagttagtgatccagggcaatttttaataaactgagcacataaaaatgaaattgatgttgattttttgccaggaccttgcgcatttgtttctgcttttgtcctttccggttttgattcacctctgatttttatgggtttttttaattcacgaaaacaacaaataattaagcaaataactatttttaagccaaattttagttatattttttatatttcaccgcataaattaattaatattctggaagtaattaaagaaatttatggtgataatattgaaatatttttggtaaaggagatgacaaaattacaccaaaaatatttttttggcacaccaatttctataattaatcagctaaaagactcattaaaaggcgaatttacaatggttttgcggctaaaaaatgagaaggatttgcagataaaaaaaaagaaaaataaatatcaaaaattttctaaaaataatgtataattaaaagttaaaaatatttgaggtgttaaaaaatgattaataaacatataagtcaaattctctataaccgtgatcaaattaaagcgagaattgctgaaatcgggaagtggataaatgaaacttataaagattctaatgaaattgtttttataggtgtgcttaaaggttcgctaatttttttaactgaattaattcagagtgtagatgtggattcaatggttgattttgtgattgcaaaatcatattttggtgggtcagaatcaactggtgaattaaaagttattacagatattgatattcaaatccaaaataaagatgtaattttaattgatgacattcttgattcagggataacattatcaaaaattagggatcatttaaaattaaaaaacccaaaatccttaagggttattactctttttgataaaaaggtaaaaagaaaatacgatattcaagcagatgtttctggctttgtagttccggatgcttttcttgttggatatggtcttgattatcaggataaatatcgtaattgaccttttgtagctatttttgatcctaataaatagtaaaaaaaaaaaaaaaaaaaaggtaattaatgataaaagtttccgatgtttgctttagttatacaaacaacatggaccagcttgtgctgaaaaatattaatgttgtttttgaaaaaggtaaatattatgcaattctagggcataatggttcaggaaaatcaacgttttctaagattctttcaggaatttttaaacctcaaaaaggtagtattgaagttgatggagttttactaaataaggaaaatttaacgaaaattaggaaaaaaattggtataatttttcaaaacccagataatcaatttgttggggcaacggttgaagatgacatcgctttcagtttggaaaacattaatgaggatccaaaaaaaatgagtcaaataatcgcaaatttagctgcaaaagtgcaaatggagtcatatttagaccgtgagccacaatttttatctgggggccaaaagcaaaaagtagcaattgcatcagttttagcactaaatcctgagattataatttttgatgaaataacttcaatgcttgatcccagaggtaaatatgatgttgttaaaattcttgatgatctaagaaaagataaaacaaaaactttaatttcaatcacccacaatatgaatgaagcaattttagctgatgaaattattgtttttgcaaatgggggaattatcgctcagggggatccaaaattaattttaaatgataaaaatatcatcgaaaaagcgaaaattgactccccatttatctataaaatttccagcgcacttaaattagttagtccaacttatgacgaaaatgaattgctagagcaactatgaaaattaaagcaaaaaacatcgtaaaaatttatgatcaaaaattaccatcagaattaaaagcccttgataaagtaactactgaaataaatcagggcgagtttattgcaattattggccaaactggttcaggaaaaacaacttttattcagcatatgaatgcacttttgctaccagatcaaggcgaaattgagtatctctattttgattcaaaaaatcaagaaaaaaaattagttgttcaaaaaccgcgtttttttagaaaaaaactaaaatttattaatgaaattcgtcggcgtgtgggcgtcgtttttcagtttgctgaatatcagctttttgagcaaacaattgaaaaagacatcatatttggggctgtttcaatgggaactccaaaaaatgaggcaaaaaaaattgccgcagaaataattgaattagttggtcttgatcaaagttttttacaaaaatcaccttttgaactttcaggtggccagaaacgccgagttgcaattgccggaattttagcaatggatcctgatattattttttttgatgaacccacggccggacttgatccccaaggaacgctaaaaatgcttgaaattcttgatactttatataaaaagggcaagacaatcattctggcaactcatgatcttgatagtgttttagaatgaacaaaacgttgtattttttttaaagatggtagaattatttatgatggtgatacttattcaattttagcaaataataaatttttaattgaaaataagatgttaccaactaatttactcaattttcgcgaaaaattaatcaaaattggttatccaatttctaatgttagatcagtatctgagttaatcagtgaaattaatatgctaattcaaaaggaaacaaatgcagattagtgttgcaaaatatgtagctcaaaatacaatcattcataaaatggacccgcggctaaaaattgcttttaacatcctttttgcggtacttttttttgttacaagtcatctaattacaattttaatcttgctttttgcagcattagtatttttttatattactaccaaaaaaataaagcaaatttttaccttgatgaaactgcctttaataatttttctgataatgattataatttatggatttattattgaccagaaaaatattaacataattttagggataaccgcaccagataaagcgccacaataccgggttttgggtctaaatgaacaacagacaaatgattttatttcctgatatttagtaaagccgactgttttgttttcaaatcttaagttctcaattggcactgttagcataattcgctcatttgttttggcgatccgaatttatgcaatgataatttcaacaacaattctgacctattcaaccaaaccatttttattaactagggcaatcgaggacttaattctgcctttaaaacttttatttattcccacacacattatcgcaatgattatttcaattgcaatccggtttattcctactttgttattagaagcaacccgaattatgaaagcacagtcttcacgcggagttgattttaaacacggaaaaattaaggataaagttaagtcattaattaccttgataatcccactttttgtattagcgttttctcgagctgaagatctttcaaatgcaatggatgtaagaaattacgatgtttatgcaaaaagaagtcgttatcgcaggctagtttttaataaaatggattatttatttgccctaatttttattagtttaattattttaacagttttaatggaattaaatataattccaatttcgcatctgccaaaatgatgattatacactaatcaaaaaatttaaattatgaaaaaaaacagtcaaattcgcgcgaaaattattgaactaagagaaaaaattgaaaaatgaaatcaccattattaccaattacagaacccacttgtcgatgatttagtatatgataaaactttaagagaactagaaaaattagaacgcgaaaattttttcttatttagtcttgaagaactaaatcaatcaccaagtcaaaaagttggatcaaaaattacctcaaaatttgaaaaagttgctcattcaagtccgatgttatcgcttaataaggcttattcaaatgaggaattggaaaaatgagcaaaaaaagctagcgaaattcttaaaacagttacattttttgttgagcctaaaattgatgggattgccctatcacttttttaccaaaatggcaatttgattaaggcattaacacgcggcgatggagtttttggggaaaatgttttagttaatgcacttaaaattaatgatgaatttattccgaaaaaaattaattatcttgaagatttagaagtccgtggggaaatttatattgataattccacatttgcaagtttacaacttgagacaaaaaaatttaaaaacccccgtaatgctgcaagcggaattctgcgccgttataaaaatcacaagccaaaaattgatgcaaaaagtattaaatttcttgaagaagaatccgattttagatatttaaaaagttttttttatactttagtaaaccctgaaaaacataagataaattcccaatttgatagcattaattttctaagaaacttaggttttcaagtaaatcctttccaaaaaaagtgctctgatttaaaagatgtttttaattttattagcataataaagcaaaaaagagatttcctaaattataatattgatggtgttgtagttaaagttaatgaattttctatctatgaaaaattaggctcaacttctaaatttcctcatagcgcaattgcttttaaattcgaagacgatattgcaaaaactaagcttttagcgatttttgcaacaattggaagaacaggaaaagttacttataatgcaaaaattgagccagtaacactggctggaagtaaaatttcatcagcaattttaccaaattattcttatattgaaaatttaaaattgaatttaaatacagaagtttatataaaaaaagccggcgaaataatcccacaaatcattggtagcgttcataattatccaaaaactaatttttcaatagtaaaaaattgtccaaaatgtaattcagaattagtcaatagtgaatctggacttgatcagttttgtcaaaatcaattttgtcctgaaattattttgcaaaaaatagtgcatttttgttcaaaaaatgctttaaatattgagtccttagcccaaaaaagaattgaaaaattccttgaaaaaggtttgatttcttcggcttgcgatattttctatctaaaagataaactcgaattaatctatgaaagattatctaataaaaatcaactacttaccaagcaaaatgcttctcagtcaatgcagattaagtcaattatgaagctattaaatgaggtcgagagagcaaaaaatattgatttttatagactaatttttggtttgggcatacgaaatgtgggtctaaaagcagcaaaaattctttcacgttatgcaagtaatctttcagaattgagaaatttagactttaatttacttaaaaatcagcatgattttggccctgttattattgaatctctaatcgattattttaataatcaaaaaaattctgagcaattaaattgtcttgaaactgttgggtttaattttaaaactacttttttaactaatcagtcaaattcctgagctagttttgcaatttcgggaaaattgagcaagccacgcgatgaatatgttagaattattgaggaatcaggcgcttcttttcatgaatcacttacaaaaaaaactgattttttattgctaggccaatctgcgggttcaaagatagaaaaggctaagaaagccgggataaaaatcattaacgaggtacaattttttgatttaattaaaaattctaaaaaaacttaaattaaaaaaatactataaattacgttgtttttttattttttcgaatcacaatagaagaaagtttagactatggcaattgcaataatcgctgaatataacccgtttcataatgggcatatttatcaacttgaatatacaaaaaaaaatttccctaatgataaaatttatataattttaagtggaaatttcacccaaagaggtgaaatttcccttgcagattttaaaacaaaaagtaaaatagcacttaaatatggggctgattttataattaaactcccttttgagtatgcaactcaggccgctcatatttttgcaaaaggcgcaataaaaattgttaatcagcataaaattgataaaattatttttggatccgaatcaaatgatgtagaaaatttatataaacttgcaaatttatgaaatcaaaatcaagaagcctataatgcatttttaaaatatgcccttaaattaggttattcctttccaaaagcatcagcatttgctttagaagaaataagtggtcaaaaaattgtttttccaaatgacattcttggctttgaatatatcaagcaaatagttgcaaataattacccaattcgcgcttatactttaaaaagaagtgaagaatttagcctgaaaaatcctgagccaaacattgcatcagcaacttatttacgccaacttgttaacgaaaataagtcaatttcgcgattttcgccgatgaaatttatacacccggtttgttctttggcaaatttataccctgaatttcaaaaaatagtccgtgaaacttcccctgaaaatttagcaaaaatttgactaattagcgaagggattgaaaatttatttaaaaaacatattaatgagccaaattttgaaaaatttttaaatgctgttaattcccgaagatatacaaattcccgaattaaacgagcgatggtttatattttatttagaattgaagatccaagtcaatttgatgaagaaaaaattcaacttgattgctgaaaaaatcagggtttttagcgttttttttgtcaggaaataaaaatttttcaaatctgatcaaggaaaattgcggctgggattaaaaaaagtagaaaataatgattgttatttttcagtattatcaaattagaaaaaacaaaatcttttggcgaaaaaacggcgtttagtccaggagttaaacatactaataaaattgataaaaagcttacactaaatccaagatgtaaaaattttaaatcagaaaaattatacctaataattggcttgtttgtagctaaaatataagaaagacttccaagatttaagctgataattataaaagaaattactgaagattttgtaatccaaaaactaaaaagacctaaaaaagtaataaaaattgcccaaaaaccaatttttaataacaactttttattaaaaagttgttgattttcctctagaaaatttttattcattacatttgttacaatgtttgtaagtcctaaagctatcccaccaaaagtttccgagacaacgttaattcaaagaatttgcagacttgaaaaaatttgttccctgaaaattaaagtagcaaaaatcaccgataaaagcatcgtaaaattagcaattagtaaaaacgcaaaaatttgcttaatatttcgaataatatttcgtcctgttttgatagccaaataaagagttttaaaattatcatcggcaagaataacatttgctacctgttttgatacctgtgaacctgttattcccattgcaaaaccaacatcagcttttttaagcgaaggcgcatcgtttactccatcaccgagcattgccacaacttgtttttttgcttgtagggcgctgataatttctagtttatcctctggttgagatcgtgaataaaggtgaaatttttcgacattttcttgtcaaaagttgtcttttttccaatttgatgcatcaacaaaataggaattatctttaataattccgacattttttgcaattgcaaacccagtatgaaaattatcacctgttatcatcactgtcgaaatttgcgattttgtaagtgagttaataattgattttattttttttcggggtgggtcttggaaaccaatgaggcccgaaattttaatatttttaagatatttttctaaatttgaatcaaaattttgactattactaatttcgagataaccaaatgcaaaaattcggtaacctaatttttgcatttttagaagtttttcatttaaattttgctcaagattatcagccattttaaaaataatttcaggcgcgccctttataaaaagaaactttttcttgttaaattcataaaaaattgctgaaaatttccgctttgaactaaaaggaattttatcaaggaatttatattctttttctaatttttctttttcaatttcaaagttttttgccgtttttaaaattaggatctcttcagggtcaccaagaaatttttcaatatctccttgaaaaaaactataggcacttgtatttaaaactgcctgttttcaaaaagttttttgctcaatttggtaatagaaaatatcagttatttccattttattttcggtaattgtccctgttttatcagaacagacaatcgagactgctccaagagtttcaattgtctttaaatctttgacaattgcattattttttgctaatttttttattccaataattaaatttatgcttacaagtgggacaagtccttcgggaataaatccaattgcaagcgaaagcgagactataattccttctttaaaatggctaaaatcaccagaagctattagaaaaatataaacaaaaaagaaaaaaatcgctaaaaaagctgcaataaaagtgataattttaataaatttttgaatttttttctgtaaaggtgagctagcttcttctgttttttggacaaggtcggcgatttttcctaattttgtttttgcaccaatagcagatactaaaatttttgcatttccacttaggacacttgagccactaaaaacttggcaatcctgattatctcagtttgtcattttttctttatataccgaggttgactcgccggttagaattgattcagagactgcaaaatccttcatttcaagtatataaccatcgccacttatgagatcgccagcgctaacttcgagaatatcgcctactaaaatatccttagaattcaggcttatttttttaccctgacgaattattgtcgaaactggtgagttaagatctgaaagcgctttgattgctttttttgattttgcctcttggataagtgaaaaaaatacattaattgtgataataattccgataattacaggctcaagataagaaattatttttgatcaaaaaggcagatcagattcaaaaattagactaatcaaaatcgagataataattacaaaaattaaaacaagggtaagcggttcttttaactgatttaaaatccgaaaaaacaagcttttttcgccaacttttggtaagctattttgaccaaaagttgtttgtgaaaataaaatttgttcttgatttagccctttttccctatcaacttgttctaaaaaaggtaataaatctaaactttttgcattattttcttgattttttactttttttgacattttagtccctttttttataaaattgtataaattagatataaaataaattactattaggttataattataatattattttaggtttaaaaatggaaattttaataaaaaataagcgcgccaattttgactatgaaattattgatagatttactgccggaattgttctatttggttgagaggttaagtcaattcaagcaaaaaacatttcgcttgttggtgctttttgttattttaaaggtcatgaactttttctttcgaatgcaaaaattagcgaatataaaggttcgcgtggtcaaactgatcgaagtcgtaaacttttaatgcacaaacacgaactcaaaaaaattctaaaagaaaaaattacaagaaaactagcaattatcccactttttattggccagaaaaatcgaaaaattaaactcgagattgcacttgcaaaaggaaaaacaaaactcgataaacgtaatttgattaaagaacgcgatcaaaaaagggaggcagcaaaatttttaaaaaattattactaatttttagtttattaccgctattttcaatttcaagttgttatgatcttttcactagctccttaaaagatgaaaatactatcaaagatggaaataatccaataaaaaactttcaagttttcgaaaaaaattcattaattcgcaaaggtctaaaatatacaacttttgtacaagatgtctatgatggtgatactttcactgataaaaacaaccgtcattttcgactttttgggatagatactcctgaacttcaacttcaaagacccaatccaagaataaataaaaaattaatgaaatttcacggtctacgggcaaaaaaaatacttcaggatttaattcttgaccgttgaatttcctttgagatcgtaaataccgatccatatcatcgacttgtagcaatcattagcaatgaaaatggtgaaaatattaatctgaaaatggtagaaggtggttttgcaattaatcgttatagtcaatatgaaaatcaaaaaaaaaattattattacccggaataccgcgatttaattaatgcattgcgaaatgcccaggaaaaggcaaaaaacaaaaatttattactttgaagggatggaattcttccagtttatggaataaatccagtgctaaaataaatttctaattcatttctaatttaaaaaacactataaaaacaagtgttttttaaattagaattataaaaatagaactaataattttgtctaacaaagcaaagttattagttcataaatttttgaaaaaattttattttatatatgctttaataaaggcgtttcttatttgatcgcgggcaaaatttcttgtctttgttgttaattctggatcgttataaactgctattccttttaaaattatgctgctatttttgttaattttttcgttgttagaaccatttttatccgttgttttttttggatttggcccaatttgggcccagtcaagatttagataattcggaaatggtgaccatttttgacttactgggttaatattatagatagtttttccatttaaattaagtgatgtttttgaatttagctgataatttgatgatgaaaaagcactaatttcaattgatcacggagttttgataatttcaaggacaatatcttggtcatcttcgattatttctttacttttttcaagtaaaaaaggactagaatttcttagttcctggcgataaaaacgattttcgccagttcgatttgcaagttcaactatggctagattgtctaaattttgatttatttcagcgctaaaattttttattggctttcaggaattaggcccaagaattactgcttgcttatcaattaattcaggtgggaataaattagctaaggaataaaggctttttttgttctggtacaaatatgactgaaatgatttaaaattttttatctgtttaaagtcaagtccgataaaataaccatcaacttgtttttgttgtgtttcatctttgtttttttggtctaaattttcgggtttgataaaggtaatatccgaattttccgtagttttttcagtttttagtcctgcaatcccttggattgtggtatttttatttataaatttaaaatttttaatcttttgaataaaaagaccgtttccatctgagtctgcaagtaggtaatgttttttatagtcattgatattttttggtttaaatgctaaataaattagccctgaatcaagccgtgaaaatggtgctgatttgaaacttgggctacttatattgactgttctggcaatattttcttttgtttttgattggttttgctgaaatttaatcggatttgttagtttaaaaccttcttgagttagttgatttttactatctaaatcatcctcaaaatgaatattattatcagataaatctataatttcatagccttttttattgtctgattttgaaaaagatgacttgccatcaagaaaaaaagttggataaaatttagctgcatcatcaaaagcgctcatttcagaactgacaatatttgaaattttaatctttcttgtggctaatttttgcttatttttatttgaaattagactaaatttgatagtaaaatcaccttccttattatcaaggataaaatcagagcttatatcatcatttattaaattacgctgaatattaagcacttttcaaattgcttttcctaaacttttttcattgttttgtgctttattaacctgatcatcactaaattcttggactttaactagttgatttttaaggattttagcagttcttattaattctcttttataattttctatagcaatttcatcaccaattttgccaaaatcaagtaaataaagttggctaactaactttatatcaggattttctgggtctaattcattgttaaattccttaattttatttattatatttactagttttttactagttcacgctgctgaattttcatcttttcttagtaagaatacctcagattttggctcgggtagattttgtgcaaaaatccgggcatactgattcaggtctggttttaggtcccaatcaaacttaaaacttaaaattttaattagtttttgttggactcactttgagatatcaacatttatttcaagccgaattttatcatcttttagcaaattattaagttctaaagcaggtatttcactattttttttgattttaaaatttatgtttgtgatataattttttattttattagtattaattagatgctcgctttgtacataatcaaataagttttcaaaattttttgttgttgatatccaaggattattatttttatcaacataaaatgattttgcaagtgataaattttccctaattaattcagcttgaatactttccttgagcttgattttttcttctagttccgcttttattcacttaattatttcatttttaatctctaaatcaggggttattccgttaatttctaagggaatttctgttttttttccttcatttgtgaagataaaattaaggtaatttttattcccttggtttgtaaaattaagattattatcaaaaatttttggttctaaaatttgccctttatgaataaaagttggtaagccgagactgttaactaaattatacgaacctccaagttgaataagcgcctcttcaaaagcaataaatgtttgtttttgggttttgctagttttaataaattgattttgtaattccttgctaaactcagcaaaacttaaaaaattttgcggtttaattgaaattgatgattttttttcatcaatttcaaatttagcaagatttttttcaatatttttatcagaaaaacctttaatttcaactgcttttgaaaaaatttgccgttgatcgctagttcttataaaaaatacaatatttttaattgcagttccacttgctgttgcattacttagatcataactaatttggtaatttttttggtatagtttatcaagattaattaacgttaaaaggtcaagattataaatcttgctttttgctaattcaaatgctgtactagctgataattctttgaattgattactaatgaataaattatcaaagaattttccaagattattttcaaagggattttcagtttgactaatacttaaattttgtgatttttcatttaatttttgataataagcgcgattatatgaccaaatacctaaaggaattgcagttgaaatagttataataccacttagaagcaaaatgctagttacaatttttgctggtttattaaaaaatcctttaaaattaggtatttttttcattttagacctcttaattttgtatttttatttttctaaaaattaattttttattaatttttagaattttttgttattataatttttaatttctgccttgcaataattggatttatctggctattttcatcatttttattatcagcttttaaatctttgggatttttatccttcttattaagataaaaacttattaaaaaggttagtttatccgtatttagtgagttttcaaaacttggttcaagtaaaaattttgtctcctctttgggaaattgttctttaaaataagaactaattttatcaatatttatggaagtttctttaaaatataaatctaaatcgttattattgtcattattttttggttcaggtgaatgcttatttgttaatttttccttaatttttttaaaattttcttcactgacactataacttaacaaatcagccggaacactttcaactaccttatcgaatttttcttgtattttagaattttcatcaattttttgagttgagaaatttattaaaattttttgaattgggctttgaaagaaaaattttttctgactagaatcaccaataatatagtaaaaatttaatgttagatattcattatcaacattggcattataagtattatctttttctaaatttccatttattgatttttttatgttattatcagagtctaaatttttagattctggttgaatttcagaatttttatttaagttttcctgtttttctaaagaatttaattcgggtttttttagcttctgaatttcagaatcataacgagcttttgaaatttcattttctttttgaaacacaatttgataatctaaattggtatctaattttgttcaccctaaaaaattatcaagttgactagccttataataaaaagctaaaagaaggtcggccaatgttgtgaatttaacacttgattttaggttttcctcaatttgttgtcttgtaaattttctagctgtttctttaaaaagttcttggtcttctaaaatactaattacatcagaaattgacttgctttttagattattgaatttatcttttattgattttggaagaaaaagggatgaaaaaaacccttgattataaaaatcagcgaaatgattattaaaacttaaaatatttgtagttttattatcaaaatgaacttttgaactagcttcaaagatattttctccagccaggttattaaaaatttgcgaagcagtccgattttgatttaaaagtccaaaagcctttgcaattaagaaaaaactatttgctatttggcttggttttttctgaattaaatcagcaaaaaaagctgttacatccgaaggatttataaaaaaactttgtgaatgtagtgtttttagttcaattttttgctcttgattttgtgaatttatatcaattttttgttgatttaatcgaaaatttgcaatttctgttaaactaggtaagtatgtcttaccagatcaagcccgaactttggcctcaaaattatcaaaattaaaattataccgtgataatgaatttagctgtctttctaaacctttataatcttgttgcaataataaattatcaatttcttctttttttaagggattattcgaaatgaccggttgaccaaaagttgaaataaatttattttcatgactttcctcatcattaaaaagtgaatttctccgataaattaaagctttctggcttccgggaattattagattttgaccatttttatttgatataccaaagccgccaatacttaaaaacaactctttttcatagataattttttgtgaaccaggtttaaataaggattctctaaggaaaattttatagggaatttcaattatataattatcattttcattttttaatttagcattttgttggataatttcaaaactaattccgttttgattttgtggaattagttttgaagtcggcccaaaatctagagctaaatcctcttctaataaagaattaataaccccttttatgtaattttggttagtattggcagataaaattccggatttaatttttgaaaatatgtcaaaaggattcagtttagttattattaattttccgtctttttcttcagtgttaaattttagtggttttagtttaatattttgaaaaaaattctcaacattgaaaaataatgattttttatcattagtttcaaatctaatttcaaagattttttcgctaaagttttgaccaatatcacctaacatttttgcggcttgatcagttaattttgcctcaagatacatagttgggatattatcttgtagatttacaaattgattattagttttattttttataaatttaagactaaaaatcggattttctgtttttccaattttattatctttcgattcgcgtgcttgtaaaatcaagttagataattcagggaaaatttcatttattttgacctcaacctcgtttggattttcaattttattaacttcttgcgcaaaatcaattgctctgtataacttttttaatttttttttactagtttgatcagaaaaatttgtggtaaaattacctatatttaaaatattttcattaatttggcgaaacattttttgaagaacaaagttaaaatctgcttttaaaaatttatttgattcataaaatgtaattggttggctgaaaaaatccgaatatgcatattgattatttttttgtttttgcctaacacgaaatttaagattaaaattttggtttaaatcatcaaattttaaatcactaaattcaaattcaatagaaaaaggatttgaatcttttgagaatttaaccaaatcattagaatttttatcaaaaatataaaattggagatactcttcaagatttatttcttttttaagctgatcaccggaaaacaatttttcttttatttttcagaaattactatttttactaatttgctcaggtttaaaactaacaaaactaattttttgtgcaaattcattaacttttgcccgcgggtgagaaccattatatttaattgttaaactaattccgacagaagtagtaaataaaattaacccagcaaaagttgaagctagtaccaaaattgcttttttatttttgataaatctgccaatcaaattagcctgcattaaaagctcacctccgcgaatttacaatttaattaaaattataccatattttaattttttagtaactaaaatccgaaaaggattgtgattttaaccaaaaattattagaagccactaaattattcaagatctaaacttatagtttagaatttttttctataggataatttaggtgatttcatgttattaaatctgattaatttaaacccgagtaaaaaaaaaaaaaaaaaaaagttaaaaatcaaccttgaatttctataagcaagtataacttgaagacattaaaagttataaaaaattgtttatttttattagctaaaaggtaaaaagttgctatttttaaacatttttttaaaaaaatgtaggaattttaaagtatattttttgaaaatttttacctattatagtataattgataaacattataattaagtaattgaaataataaaattttaattcttaagaaaaccaacatttagaatcgagatttaaaaaatatgccatattcccttaatttaatttcaagtttgctaaaaagaatgacagattttctaactatctttggttttaaatatattaaatctaacgaattaacaacttttgagtataattttatcaaacttaatattgactcaaaacatccagcttttgatcctagtcagagtttagtttttagcgataatcaattgcttgcaactcataaaaccggaatttcaatcgaaattataagtaaataccctaaccaaaaattagccttttactcctatggaaaagttttccgtaatgacgaagaagatgcaacgcattcgcatcaatttaatcaactagatttagtagcaactggaaattatagtgtttctcatcttaaaagtttaattagcgacttacttgaatatgtttttgaagaaaaacttaaaactcggtttcgcccttcttactttccatttactcaaccttcttttgaggttgatattttctatcataatcgctgaattgaaattttaggttgtggacttttacatccaaaggtgatgaaaaatgcaggatttagtgcaaaaaaaatctatggaattgctgcaggaataggaattgaacggctagcgatggtcaaatacggaattagcgatattcgggaattttataaaaatgatttacgttttttaaaacaatttaggtaggtagagagtaatgcttttttcattaagaagactaaaaaaattagcaaatttagaggcttttagtgaccaaaaagtaattgatagtttaataaatcttggttttgaagttgatcaaataacaaaattaaatgaaatttccgggattaaattcggtcaaattttagaaattagaaaaaatccagaagctgataatctctgaatttgtaaagttcaatttgctgataaaatcagagaaattcaaacagcagcaaaaaatgttatagaaaacaaacaagttcttgcatttatccctggttcaaaaagtggaaatactacttttttggcaaaaaaattacgcgggcatatctccgagggaatgttaatatctgcagtggagctaggttttaataagcatttgttaaattcagaattagatcaaggtgtgcttgtttttgatccaatttttgatcttgaatctaatccacttaaggttttagaactagatgatctaattttggatataaaacttttatgaaatcgaccagatggtaattcatatttggtcttggcaaatgagcttgctgctttttttaagacagattttagtctaataaacaaggaaattagtggtaaattttattcagagcttaaaattattaataaaactgatagtaaaatttttgcccttgagattcaaaagttacctaaactagcattagttgacatttttttgcttttaaaatcagaagtaaaaattggcaatttagctcaaaatttctctaattttatcctaatttatacaggccaaccttcctattgtctccaattagaaaaacaccagcaaaaagttgaactaatagagcaaaaagttaaaataaaatacgagcctgatacaatttcaagttatcattttcttaatcaagaaaaaaaaccgttattaattcccgagttttctgatcaaataattatggaaaataatagttttttcctaataatgccaaaatttaatttgctgaaggtaaagcaaattaaacaatttttaaagaaaaatagtctaaaattaacccagttaggaaaaaattataattatgggacaacttttatcgccctatcttttctaaatttttttctagaagatcaaaaaattgacttttcctgaccaattaattttgataagagtttaatttccaaaaaaacttttcttgatttaaattataacgagcttaaagagattttaggtctagaacttagtcaggaagatattagtaaaactaatttaattcttgaaaaaatcgggtataattttgataatactagttttagtccccctttttatcgggttgatattgaattttttgctgattatgcggctgattttctaagattttatggccttgaaaaactaaaagactgcaaattagagcaagtaaaagccaaaattccaaacccggattttgaacccgtgaaacttaaaacacttggatattatgaaacaaattcatttcttttgatttcaaaagaagaaaattttaatccactagaacttaaaagtcaggatcttctaacttttccatctcaagaacatacaaaaattcgttattccttagcctgacagcttgcaaaaattaccaaatacaaccaaaaaagaaaaataactgagattagtctatatgaaaaaggctcaattgcaggctgaaatcattctttagcgcttgcttcaactatttatacaagtgaagacttaaaaaagcatttaaaaatattgtataattatgatttcgattttcttccagcagattcagaattcctcaatcccgaaaagtcacaatttatttatcttgataatgtcttagttggttgactaggtcaggttgcggaaaaatataactatgaaaatgttaattttttagagattttgctctcaaaagtggaaaaaatccctaaaaaagagggagggaaaattaaatttagaccttatgataactcccaactaaaatatcgtgatatcacgctttcactgcctatgaaggatattcctgatccttatctaaaagtaattcaaaaaattccagaaattttttcggtaaaattaataaattatgttataattaataatcaacaaaaaattacttatcgaatcacaggacctgatcaggtttgtgcagaaattgataaattctataaataatttcatttttttattgatatttttatgaaaatgaaattatttataataaaggaaagaaatggcgatagttcccaagagaaaaacatcaaaacaacgtaaacataaaagacagtcgcattcagcgctgaaattaccaaatttagtcagttgtagtaactgtgcaaataaaaagctacctcatcatatttgccaattttgcggtttttataagaaccgcaaaattataagttttaaagcagtaaatgacaaaaattaatgaattaattaatttttgtcaatctttttgtgtaaaacaaaaaaaaaaaaaaaaaaagtaagaaaaaatttgttaaaataaaaatttatagtataattattaatacttttattactatgccgatttagctcagcggtagagcagctggctgttaaccagttggtcgcaggttcgatccccgcaatcggcgccattaggcccgttggtgaagcggttaacacacatggttttcatccatggattcacgggttcgattcccgtacgggtcaccaaaataaaggaagattagctcagttgggagagcaacgcccttacaaggcgaaggtcaggggttcaagtcccttatcttccaccatttcgccactttagctcagcaggccagagcagtcgccttgtaagcgaaaggtcgtaggttcgattcctataagtggcaccaaaaataaaattatttcttaaactgcgtgtacttttgcgcgagtggtgaaatggcagacacgctagatttaggctctagtgccttcgggtgtaagggttcaagtcccttcttgcgcaccacgatgataggtcaaccttgtgttgattttttttttttttttttttttttttaaaaaaaagaaaaaaagatgattacatttttatataaaccaaaaaaaattagctccgcaaaatttctaaggcagtgatcaaaaactaatttgattaaaaaagcaggccatgcaggcactcttgatccattagcatccggacttttattggttgcaactgaagatgatacaaaattattacaatatttagatcagaagacaaaaacttatttagcaaaaattcagtttggtttttgatcaacaacctatgatgccgaaggtcaaatttacccggtggaacaggcgattaaagttactaaagacaatttagaacaagcattaaatagattatcagaaagccaaaaacaggttccaccagttttttcaagtaaaaaagtatctggaaaatcggcttatcattatgctcgtcaaggtaaacagattgaattaaaaccgattagtattaaaattagtaaaacaattttaataaattttgatgaaaagctgcaaaattgtgttataatgtgacaagtttctcgcggttgctatattcgctcacttgctgatgatttaggaaaaatgctaaaaactagggcatacttatgtgatcttgaaagaacaaaaattgggaattttgataaaaaatttttaaatcaatctttaaaacctcaagatttatttgatttgcagcaggtaaaattagatcttgaaaatttagaattattattacaaggtaaaaaaattaattattttgccaaaaacagcgagctaaacaccttaattttcaaagatgaagttgttggttttggtaaaataattaataatgtactaattacgaaaaaattgtttggcaaccgtataaaaaaaataattaatacttaaaattcactacaaaatgaataaatttaaactttttgccacagatatcgatgatacaatagtgccccatggtggtcagataattcctgatcaaatccagttattatttgcaaaattaaaagaaaaaaagataatttcaacttttgtaaccggccgtgattttatcacaattggtaatttgatagcggcaaaaaatgttgatttttttattggtgctaacggtgcctttatttatgattttcaaaaaaaagcaataatttatgaaaaaactattgggataagtgattttttaagaatagtcgaattttttgatcagcgcaaaacaccttatgtaattatgggaattaaatccatttatacctcaaattactatccaaaaatttcctctaagttcttacgaatttatctagataaaattaaacctttatctgaatgtgattttaaagaaaaatttcatatttttacaatatttgatgaccacgaaagggtatcacagattcaaattgattttgaaaattttattaatgagaaaaaacttaatgtatcggtgagctcgcgttggtcatgaggtttttttattggagcaaaaaatgttgataaaatgtcaactttagaagttttagccaaaatgaataatatcaaaacaagtgaaattattgcttttggtgattcccgtaatgatacaaggatgctaaaaaatgtcggttatgggatcgcaatggaaaacgccctggatgaggttaaggaagtagctgatgatctagccccgccgatggaatcatttggggtttatcttaaaacaaaacagttaaaaataattgactaaaatggtaaaagtttatacttatccgttagctaatttcgatttaaagaagccagtttttgtccttggtggatttgaagctttccatttagggcatcttaaactattaaaaatagccgcagaaatcagtgatgaaattgtttttatggtaattaaggacccgtcaaaattacctaaaaatacaaaggaaaatttttcagatttaaatgctcgaattcagatgatggcaaattcaggggttaaaaatatcatcctttttgattttaatactgaattacaacaactaagaggtgaaaaatttgtcgaaattttccttaaattacaagtagatttttttgttgttggtaaaaattttgcctttggaaaaaatgctagttgaaatccagagcaattacaagaattttttccaaggacaaaaattattgaacatctaaaagatggacaaaaaaaaatttcaactaaaaatttaaaattatttcttgaatttggtgattttgaaaatttgaacaaatttttggcaacaaattttttaattagcctcaaaattgatgcaaataaggaatttgtttgggataagaatcttatttgtccacccgctggattttacctcgcttatttggtggtagttaataaaaatttaaaatttcctgtaattttacaaataaaatttgcaaataaaactggaaaaattcattttttttccaaaaatgaacattttacgggttatttagaaattattaagcaaattcgttatatttattcaaaccatactaataatctcagaaatgatgatatagaaattgctaaagatttttttctaaaaaattataaaaaaaattaatgatttttaatttttttataccaaagacgtctaaattcattaaaaaattctgaacgagaactatttaatttttttcgaatttttaacgaaattagatcaccaataaaaagttgtgatactttagaaccaactggaaaaatactattattttgttctaaagtatcaaaataaactacttctgagaatgaattcttttccaaatttgtatttgaagttataaaaatggtgtttatttggtgttgttttgccaatttagtaagcgcaactgcatcgcgagaagccattgaaaccgaaaaaataacgaggcaagtactaccaggattgccaatccatgaggcaatatcggaaatattttttgcgcataggctattaaggtgtaaatttctaagattatttgaaaattctgtagcaacagttattgaagaggctgtgccataagtaataattttatccattttaagaacagtatcaacaattcgattaatttgcgaaacattaagaattgctagtgttttctcgatactgtgtacataaagcaggttaatattttcaatttggtcgttttcgttatataaattattatcctcatcaagcttaagtcattcaattacgaatttttttaattctttgaaattgttaaatccaagcttttttgttaattgtgtaattgttccgacacttataaataaggttgatgcaagttcattgatagtttgctcaacaaattttcgtggttttgtttcaataaatcggataattaatttttcaatgtgagttaatttaaaattttttgaaatggttagaacactcataatttaacaattttacactatttttaaaaatttttaaaaaaaaatcttaaaaatttttaaaatattaaaaaattaaaatatacttaacttttataggaattaacaagaaatcctttgcgccattattataacttaatttcaagaaaatttagttaatttattaaaaggtttccaatttattatttctgagacttttagtgaaaataaatttttctattaatcaaaaaaactatgtttttatagtatttttttgactattaatcaaaaaaaaaaaaaaaaaaaaaaaaaaaaccctcaatagtcctaataaataaggctaaaaatcaataaattttttgtgattttatgatataattatattaaattagaaatcaaaaattggtagaactttttgatattttttataagttatatttatttttaaggttcgaaattagtttataatattttcttttgaaattaattaaacttaattttttatgcaaaaaacgcttaaatttatagtataatttttaatttaaaggaaattatggctaaatttattttcgttaccggtggtgttttatctggaattggtaagggcgtatcagttgcctcagttgctaatttattaaaaagttgtggttattctgtttatattctcaaattagatccgtatctaaacgttgatcctggtgttttatccccttatgagcatggtgaagtttttgttactgccgatggaggtgaaacggatttagacttaggccattatgaaagatttgttgcccaaaatttttcaaaggattcaaatcatacaagtggcaaaattttactttcaattattgaaaaagaacgtagaggcttttatcaaggaaaaacagttcagataattccacatgtaatcgatgaaataattttaagaattaaaaatgtagcaaaaaaatataaaactgattttgttctagtcgaaataggcggaactgttggcgatatggaatcaaatccgttttattttgcagcatcccaaatggcatccgaatcgaattttaaggatgttttttttattcatacaacttacattccatttttaaatgcatccggggagtttaaaacaaagccggcacaattttcaattgctaagttaaattcgcgcggaattcgtgcgaatgcaatttttcttcgcttagaaaatgataaaattgacgaaaaaattgctaaaaaggtagcaaaaagcgcctttttatcattagaaaatattataattattcctaatttacaaaatatttatcaactaccattattacttgaaaaaacagctttattaaaatcaatttttttacattttcagttggaatttcgccaaccaaaattagaaaaatgaaaagaatttactaatttattactaaaaaaatgggaaaaaacagtgaaaataggtgcgctcggcaaatataccgaatttcttgatgcttataagtcaattttagaggcttttaaaatttgtgctgcgcaccaaaaagttaatcttgaattagagtttgttgatacggcagataaaaatttttctctggccagactaaaaaattttcagggaattattatccttcctggttttggctttcgcggctttgaaaataaagtagaagcagcaatttttacctaccaaaataatataccaacaattggaatttgtcttggaatgcaggtgatgacagtagcgatggccaggcttaacggaataaaaaacgcccattcagccgaatttttagcagaaaaacctgatcagataagcgttcttgattataatcaccaagaaggttcaaaattacagattggcgggacattaagactgggtgaatatcaagtaatttttgcaaaaaattcaaaaattgcaaaaatttatggtaaaaattcgtcttttgaacgtcatagacaccgatttgaggtggttaaaaaatattcggctaaaattgaaaatactgattttatctttagtggtaaagatgcaaaaaccgacttgattgaagtatgtgagtcaaaatcacatattttttatattggagttcaatatcatcctgaatttatcacgcgtccactcgatccacacccactttttaatagttttatagcagctattattgagaatgtttactaattttttattttttatttaattttagctatccgaaatagaatttttaaataaataaaccccgaaattaatgaaactaaacaagccagaattactggtgagttaaaaaaataataatagttttgaaaaatttctctactggtagaataaccagtaaaaattgttaatatggcaccaatttgtaggatagttttaagttttcctcaaaaatttgcagcaacattaacgttttttttggctaaaaagatacgaaaaccatcaataattatatccctaagaacaaaaatcaatactaaaaatcaaggtactaaggttaaataagcaagaaaaaagaaggttgttgttgttaaaattttatcagtaatcggatcaaagattttaccaaattcagtaacaacgtttcatcttcttgaaagaaaaccatcaaataaatcagaaaaactacctatgataaacaaaaaaaaagaacctaaaaagagagaaaaattgtcggttttgctaaaaaaataaaggaaaaaaccgattattgttgctgcaattatccgaaaaagagttaggaaattaacaaaataagcacggatttttagctttttcttcttcatttttttcaaaaagatcgttttatattatttggtgaaattcggtacgtttcaaaatattcatcagaaagttctaaaatttgttcacttttaattttacctttttttagatcgttaattaacgactgataatatttttgaaatttaattttttcttcattaaaaaagctgagaattgtttgatcaaattcctttaaaaatgaaaaaaaatcaaaaaaatacttaatttcatcagaatttcttttttttcataaatttgacttttttttaattaataaatttaaattatcaaaaaaaattttttctgtttcatagccagattttaaaatctgatcaacaattggatctttttcaattcttagtaaatggattttagctaaattatttaaatctgacatttttaatttactaccaactacgaagttttctactaattcctcgtttttttcaataattataataattctggctaaaaaaattgccaaggatttatttgccaattttttcatttcctctttttcagtttttaattttcttaattttatacgatttgtgataaaactataagcaaaaaaaccgataattaaagttacaagtaaaacaactacaacaattaaattagtatcaaccataacattttcttatatttttttaaaaatatattatttatttgttaaaattttggtatttctctttctgaatcggtaaacttttttagcattttcatcaacttttataaagcgacaatttgggaaactagaacagccaataaaacgctgatttgttttccgattataacgataaaccaaatcagcatcacattctgtgcatttttctccagtagttctggcttccattattaccttttcaacttcaaccgccttttctatagtattttcaatttttgatcacattgaatcaagatattttttataatcttgtttcccttgagcgattaaatcaagttcttcttcaacttgagctgtaaattttgcatcaataatttctggcgaaattatttttaaattttcatagacaattttgccaaaatcacttaaaacaagcgattttgattcagaatcaacatataaatgatcctttaatttttttactgaaattgcaaaagttgaggggcgacccactttttcatcatctaatttttcaattaaagttccatcacgaaaatgggctggcggtttcgtttgatgtaatgaagattttatcgaattatcaaaatttttatcgacctgaaattttttgctaattaaactttctatatcagaaaattcaggtttaaattttaaacttggtttttcagtggctttataatatccatcaaaagtaaactctgaataactataagaaaaaatatgatcttttataggtgttttgaaagtcaaattagtaatctttcgttccggagatctcattaaggcttgaattgttgtctggtaaattagttgataaatttgaaattcaatttgacctaaatgatatttttctcttgctagttccggacttagctctaaatttgttggtctaatggcctcatgggcatcttgatcgccagcaaatcctttaatacttttagtaaaatatttaggtccaaaatttttaataataaattctttacctttttcaataaaagtttgacttagccttgttgaatcagtacgcggataggaaatcaaaccataatcgccataaccctcataaagtttttgaagcgcatttgagacactagcagatgaatattgtgacattttcttaaaaattgtcgcctgttttagcgggataacttttgggtccttccgggttgctttgctatattttttaaaaattagataaggattttctttaatttcagcaattatctcagaaagttcttcttctgaattaattcagttgactttctttgcctcattttgttgattacaataaattgtatcaaaaaaattaccattttcgtcattaattttaacttctaaattaaaatatttttcaggtataaattcacgtatttctttttcacggtcaaaaataaggcttagagcaaatgattgaacgcgacctgctgccggatttttaggtggatttttaattttatttttcaataaggcagttagccgaaatccaataattcgatctaacattcgccttgtttgttgggaatttattaaattttgattaagttcaccagggttttccaaggcttcgagtattgctgttttggtaatttcgttatatttaatccgttggtatttatcagtaatggctaaatgttcgacaagtgaagcgccaattgcctcgccttcgcggtcggcatcggtggcaattattacagtttttgcttgttttgctaactttttaatctcatcaattgttttttttttggtcttgtcaagaacataagatggagttcaagtgttaatatcaattcctaaaccaaactgtccagttttagcaagatttgtgatatgaccgacgcaagctgtaactttataacttgaatcaagatacgatgaaattgtattaattttattaggggattcgacaataattaatttttccacgattttataaattttttaattcttttcgtttaatttctttaagacgagcagactttccagaacgttttttcatataatataatttcgcgcggcgaactttatttgaccggattacttcaactttatcaacaagaggtgaatgtaataaaaaagttctttcaacaccaacattatgcgaaattttacgaacaacaaaattggaagatagcccattttttttgaatttaattacaaggccttcgaaaatttggattctagttttattaccttcttgaatcttaaaataaaccctaacattatctcctggttggaattgaggatataaacggatttggcttgattcaagaatttcgattaattttgcttgcattttgaactccctatttttaatttgtttttaaaaaattataatggaaaattaatttattttttattttttatttttaaaaatttttctcataaatctggtcgtttttttttagtaattagctctcgctgttcttgacgtcattctccaatctctctatgatttccagaaattagaactttaggaacttctaggccgcgaaaatttgctggtcgcgaatattgcggaaaatctaataaaaaatcattaaaagtctcatttttaagtgattctgggtttattatatctggttttaaccgaataattgcatcaattattgccattgcagcaatttcgcctccagttagaataaaatcgcctagtgataattcaaaatcaataaaattatcgataattctttgatcaaaaccctcataatgaccacataaaatcgtaatttcatcttcttttgcaagctttctcgcaacgctttgatcaaatttttgtccttgtggactaagagcaattttaagaccacctaccttttcaagagcatcaacaactggctgaatttgtaaaagtaaaccaggaccgccaccatagacatagtcatcaacttttttgtgcttatttttactaaagtctcgaaaattaacaacatttattgttatttttttttgcttaattgcttttccaattattgattctctacagaaaacctcaaaataacggggaaaaagtgttaatatgttaattttcatctgttgtatttagaaaaaaaattaagctcttgatgatttttgttctagaaaatttttaaaaacaccctttttagagaaaatatttctaacggtttgagttacttgtgcgcctatatgcaatcagcgataagttttttctaaatttacttttgcaaatttttgctgtggattataatatccaagcgcttcaataaatcttccatcccgtggagcgcgggcatctgctacgacaattttgtagaacgggttgaattttgatcccattctttgaagtcgaattcttaccattttttcctccttttttcaatttttattattatattaggcacaggattattaggcacaggttatagttttctaaattataccatatttcaaacttaaaacaaaaattttttaagttatttttttttttttttttttttttttttttttttttttttttttggcaaaacataaaaaataaaattcagcaagtcgtttcccaaaaaaaagatttaatttaaaaaagtaaaactattatatcaaaaaaattccaaaataaaagtttttttggaattttaatttttccatagctaatctaactcattttcaagccccaaaaatcgtttatttcaatttttgatatattttatattgtaaaaactacaaaatttgcgaacaatttcatctcagatattaaaatttaccatcatcagaaagccaaaatttggagatgttgtttgcgcacaaacaatcaaataatgcaaaaaggcatgctcttttcagttaactaataccgttaggcccttatcataaatttcctgatttgccatcaaaattgccccagatgtatgaatttcgtcgatatgatgtcgctgccagaaccaaattttcttattttgattattttttagtaaaatttggtaattttttgtataatcgctaattcctaattccgaataaggtttaattggcctgcctaatttttttagaaaatcaaaataagcattgataaaatagtcataatcactttgtttgtaaaacattttaaaattttccttataaaatttttagctaaaattttacccagtcaataattttaactaaaaactgaaattttttgtaaaaaataagaaaaaattatgaatttttgtttaaaaattcataattttgacaaaaattcgacttaattactttttaaaaaactagcgaaaatcatatcgtaataattcagtaatcggttttttataaacttttaatgaaataaaaaagtaaatcagaaaaacaaataaactaattacaaaccaggaaatgataaaatttatgaaaatttgtagaaagcccggcgtgccaaagtcaacatttgtgattaaggtataaaaatatggcattgttccaagagtcaaaattaggccagaagtcagcataagcccgcaaataacaagaatatttaataaatggataataaaaatttttcgctttttaagacctaaagacttaagaattccgattgatttagttttaagccgcactaggtttttggaaaataagacagaaaaagttataagtgcaataagtaaaagcaactgaatccctaaaaggatcgattttatcataaaagttccacttaaaagttttatttttactcattcaagatctctaaagaagataaaatttggattttcggctttaaatcttgctaaatttttgtcaatatcatcagttctaaggaaaattttagcccctgaagggtataaagttttccttaaatcattaccatttttataaaaaatgacaagattttctgattttagttgctgatttttactaagtaattccgaattttgtgttagattaaagactccggaaatcttataaggaattgcctgcccaaattctgaatcaatcataataaaatcacctattttgatatttttagaattctttattgagttaaataatttagtcgataagagcaattcacctttgttttccgggatttttccagtttctaatatcaaatttttgacgggaatattttctaggacctcttcattttttaggttaagacctgcattcaaaacatttaataggctaatttgaatatgatcaaaatcagcaaaaaatgtatcatttcgaccaaacttttgattaattttttcaactaatttataatgaataaatgaaggaattttgcctgagacatcttttagataattaaccccggcaattattacttcaaaagttgttggatttttgttaatattcgagttacgaagtttatgaatttttactatctttccaattggatctattatttttagtttatcaataactgtttttgaaaggataatttcattctcatttttaataaaatgaccttttagattcttattatcaaagaaaaatcgttttctaaaaaaatcgctctcatcgattaattcaattggggttcctgaggaaattagtgccggttttaggacattattttctggaatctcgtaatttttatcaataaaaattagattattagtcggaaaaattggtaaaactttgacagcaatttctttttgcctttcaaaattttgaaaatccttatcaaaaaaagcaatattttttttctttgcaagttcgactgaatctaactggtattgctgaatcttttcactattaaaatttgatactttcgaatcaaggacaaaaaaaagattaagacttaaaagattaattaaaaaaaatattaaaacaaaaagcgttgaactcccccttgttttaaaatcagtttttaaaaataaaaacaatgatttaaatttatcaaataaatttaaaggtttttttttaaaaaataaatcaatttctacttgtttttggttaacttttacttgattatgtttaatttttagaatctttacaaccggttttctttcaagtgatattattaagtccccgtatttttttgctagttctaaattgtggctaattattaaaattgtcttgtttttccttaattggtagagtttttcaaaaataatttcggcattttctaaatctaaattacctgttggttcatcaagtaaaatgaaatctgattttcgcgcaaaggcacgtaaaattgcaattctttgtttttccccacctgataaatcagaaaccactgtatccaaattttccttagaaatattcaaaaaatttgcatttttaatcatattttttttgctgattttttcattacttgcttgtattccaattcaaaccctgtaaatgaattaataaggttaaaatcctgaaaaactacatcaattaaagggtttttttcttctttgccatctttaaaaaatagaatttcaccaccatcttttttagtaaaaccggcaattaaattaattaaagtagttttcccaataccagattctccggttataaaaacaagtttattttcgggaatttcaagactaaaattatcaaaaatttttcttgggccaaattttttcgtcaaatttttaatttgtaccattttttactaaccaatcaatttgatatgctagataaattgttttaatatttaaaaatggtgttttgccactctttttactaatttcctgaaaaatttcattttttatacccaagataaaattttctaacttcttataatcaagtttattttctgaaattattttaattgattttataaattcaagataaagaaacaataattcaaaaaattgcggattttttatatttttgacctcaagatttgcgtttaggtaatcaacaatttctttatcattgataaattcattttttactataaattttaaaaataaattaataaatttaaataaaaaaggtgaatttttttctaattttgcattaataacattgtttgccactgcttcagaaattgtaatttttgtttttgtatcaagaaaagcactcaataatgcgactgttttgaaaaaatagaaaaaatcaactggatttttaacaaatttagcatagcttaaaatattttctaaaaaatcattgttaagtataaacaaattagaatcgtatcttaccttaaaaaatacaaaattatataaatctaaaaagaaatcatcataattttgtgcctgctttaatgttttattaaaatagtcttcaattgttggtttcaattttgaatttacattattttttttattttcagaatcaaaaatttgatataaaaaaattgtctgtgaaatatcaggtttatttggaaataattgataatcaaagttgtaattaactaagtcttctgtttttttagtaatttcaaagtctaaattatccttattataaaaataataattaattattggtcaaacataaaaagctaaatccctatttttgtcaaaatcaagaaatcatttttttatagcattcattttcgctattcaatcctgattaggataatcataaaaatttttactaacaagataaaaagaaattacccctggaattgcaggatggtccaagtctcaaactgaaccattttttaaactttttgtaaaaacattatctcagctctttattaaaaaaataattgactcatgtttttccttaattatatcagcaaaaaaatcttttcctaaaagagaaattagtgataaaatcggagaatattttataaaaagcaaagtttgtttttttgaagtaattatgggatcttcgtttatttcagggataatttcatcacttttgaagtctaattcctgcaatgatttttttattcaattcttaatttcaaaatatttttcaaaatccaaattatttaatttaaaataagagacaagaaaatttaaatcacgaaatatagggttatattccttaggaggttctaatttgtatttaaatagtttcttatccttttggtaatattcggaaatatatctaatgagttttgaaatattattttttggttttatatttatataaagatttacaatgtcataaattctttcgaaatcatacgaaatcgcatcttgaggaatattttttaatccattaataactttttcttctaatcttttgttattgacagtttttgtaatcccaataattttattaccatcaaaataatcatattttcctaatatattactttttattacaaaacttttattgcgatttaattcttcagtttgaataaaatcatctattttctgaaatttgcttgagtaaaaacctgaaggttttgaattattttctaaaatttttgatctaaatggaagaatatcgatctcaacagttcgatttacaaaaaagtatatcaaaggaatagaaattcccattgatagtatacttaaactaataataaaaaatcaaaaccgctttttgtaaaagatcttgaatttcattggtatattttattcctgaatatcctccgatagtttttcgaccctataattatctgaatttgatgatatattaacacttaaattcccataatcagctcatgcatgtgctgattgaccaaaagttgtcaccttatattttcaaccttgaaattcataatcaagtccagcataattagaattatgtgttgttttatcatttattaaatagccatttgaatcaattcctatctttgttccggctgaagcagaaaaattcccatcatatttaatttcgccaccaacctcaaaggacggactaccaataccgctgattcatgatgttacttttaatcttagtctgtctgctgtatctctttggtaccaatttcctaattttttatatctaaatttagtacgagctattccatctcagacaattttgtcttgaaaaaatcagccgccataataagataaatattggactccagataatccgattccaaaataatagtcggtagtgtttctttcagctagttgaattacccggttttcatttgccaaaagcgcaatcaaaggaaaaagaatagcatcagcttttttcgctgggtcgctataattgttggtgtggcaatcgctaatgaaacagataaaaaaacagttccatataagaagaaattcttaattctgtgtgataatttcataaaattactccataggtttttggtttttgttaattataccactttttgggagaataaaatttgattttttaaaaaaattaaactttgttctcagtattttataatttaatcacttttataagacaaaattataaaattataaaatttattaaaaaagattttcttattatggggcagtaaaaccaaaaaactctttaaaattaagtatttttttagtttttattagactatcacgtccttaaatttttgaataaaattcagttataaaaaattatattataattgtaattataattttatctaataaatttgctcgaatttttgctaaaaataatataattaataggtaatttatgtatttttgtctttagaaaatcctttagaactaaaacaggagcaaaactatgaaggaattagagagagattaaaggatttattttcaaaatccgctgaaaacagtttgaaattcgggaattatttaacctaactagttcaaaaaaatccattgatgcaaataaagttaaaatttttgatcaacaagtcccaaattcttatccctatattgtaagaaaatccggtgataatggcactcgcggttatataatcgaagatcaaaaatttttaaatccggctaaatcattaagttttgcttatgtaacttattttgttttttatcaaaaaacaaaatattatacaggccagaatcttaaaattcttacgtgaaaaaaaggtataatttctgaaaaggcgcttttgtttattgccgtttgcgtgcaaaaatcaatatcaatatttacttggggcgatcaaaatacaactaaatttattaggaaaataaagttttttctacctgttaataatcaaggacaaatcgatttttacttaattgaaaaaatcatcttagaactagaaaaattgattattaatgatttagcggtttattcaaccaaaaaaattgatacttataatatagttattaagcaaaatttagcttaaattttctaaaaaataagtcaaatcaaaagtaaaattggatttttcttagtttaagaacaacattgtaatgatcttgaaatgatttttttagattgactagttaataagaaaaattagaattaattaccaattcgaaagtggcaaatttcaccatcttttattaaataatccttaccttcaagtcgcattttaccattttctttaaccactttttcgctaccagcttgaacaaaatcatcaaaactaataatttcaacacggataaatttttttttaaaatcggaatgaataattccgctacattcaattgcgggtgtgtttttccgaaaagttcaagatcttacttcttttttgccaacagtaaaaaaagttgctagatctagaagataaaaactatgtagaattaaaagatcaagtgaagatttttcaagtaaaaactcctttaaaaacaagtgtttttcttcttcatcgagctgggaaatttcctgttctaaagcaatacaaagcggaagtaaaattgctttttctttgactaaataactttttagttttcaaaaataaggatttgcatctggattctggattgatttttgatctaaattagcaacatataaaaccggtttgatcgttagaagttgtcaagattttatttgtaaaatttcggtagaatctaactctaaatcccttagtgatttaccattttttaaatgaatttcaactttttttgcaagttcaaattcaaatttaacttgtttatcattagtattatttgccttttttgcaagtcgggaaattattgtctgaattgttccaagatctgcaaaaattagttcaagatttatagtctggatatcaaaaattgggttaatttcgttattgacatgaataatttttggatcctgaaaacaacgaacaatatgcactaaacaatccacatttcttacatttgcaagaaatttattacccaaaccttcgcctgtagaagcccctttaattagtccagcaatatcaacaaaagaataggtagcaaaaacggttttttcgggttttactatttttgttagttgaagaattcgcgggtcatgaatttcaacagtggcaatatttggttcaattgttgcaaaaggataatttgcaatttcaacattcatttttgttaatgctgaaaaaagtgaagattttccgacatttggaagtccaatgagacctgcttttaaattcattttttcaatttagacacgggttttatcataatttccgcggatgcgatcaccgataaaaggaagaagagccacaaaacgggctcttttaactgcaagcgctaattttctttggtgttttgcgcaattaccagtaattcttgagggttgaattttgccaaaagtattaataaaacgctggagaacttcgatgtctttatagtcaatataaaataatttagcctcacaaaattgacatggtttttttttgaattttttcgcgtattttttattcattttaactcctttataatttagtcatcactatctggttcaatatcagaaagatctcagtcagcaaaaggatcttcatcgtcttgagaattgcttttattcttatcagctaaaaaacttggaaaatcagagttttgtgattcattcggtaattcttgatcgtgttcggggatttcaagacctacctgattatcatcataaataggttcaaaagttggttcagatattttttggctcaacttttgccgtctaatttctagttgttcttttgtctcaagtggttgaaatgaatcaacatttacttcataattcgtcaaataagcatttgtattattcattacccgatttccctggatactgccttcaagtgcgattagagtgccaactgtgattaatcgttctaataaagttgcgttttgtcttcaagcaacaattggaataaaatcagttattggagtagcatcttgactatatcttcgacgggaaacagcaagactaaaccgcaaaaacggtacattagattttgtatttaacaaaatcggtcttgaagaaaccctaccaattaaaataactttgttcatcgttgttaataataattttagtttgaactttgtggttttttattattgtagttttctttttctttttgattaaattttggattttttatgggttgatattgtcggcgatttcgctgagtttgactagtttgattttggtgatttttgttattttggtgcatattttcttgattatgtcggttattctcacgatgataaccgctttgattttgttgattttgcccgaaattctgttgattgctgctcacttgttggaaatcatcttgattttgcctgctattttctcgatattgactagcttgattttgctgattttgctgaaaattctgttgattttttgttgcttgttggtcttgttgatcaaaacgtgatttaggatttccccgaaaatttggcttatcaaaacgatcacgtctaagtgtgtattttctgttccgctcacgaatttttggttttttatttagacctttttcactatcaagattcacaattagatatcgccaaatttctcttgtgatatttgcccgacgtacaaattcctcgattaaattagttggagcatttaaatctactaaaaagtattgcgcaatttttgattttcttatcgagtaagcaagatttgttgtttcaagtttacgtaatttttctgttgaattatcaccaaaaacagttttaagcaaattatcaataattgccatttctgcttttggatctaaaattgtcataatttcgtatttaggcattttttctccttttggacttaagggttagaaaaactaaccaaggataataattaaaaagttttaaaatttctagtttacaatttttttaaatttgtatacaaattataacacaaaaaaaaaaaaaaaaaaaaaaaagtaaaatttgtgaacggccctgatattattaattctaacacaaagaaatcaaattccaaatttttttattttttttagtaattagaaaattaaatgacaattttccagtttttcttttataattatcatttatcatttaataggcaggcacgccccgaatttttctaacgaaaaggctgccctctcttgtttttccttataatatcttagatattataaggaggaaattacttttttgaaggaaatttaaataattatacataattataacatagatatataagaattacacaaatatgaaaagtttaaaaaaatccttattttactagctattttagcattataagccctttgtttttggctgtttcttgtccaacggtttaattagcaaatctgaattatcaaaaaaagaaagtaatgtttttaattttataataaaggaaaatgaaaaaaatttaactatatttaccgcaactttagtaaaaaaaactaataataacttgacttttgtcagcgcttatggtttgttaaattcaataaaacacaaaagacagcggtaaatattaaaatttaaactaaaatagtcttgttttgtttatattctattaggttataaatagaaactataggcacaaaaatgtctaaaatatataaaattagtgaagttcgtttggaatgcatattaacagaatctgctaaataacgaggcccaatgtatataaggtaagtcatagttgaaatattaaataaattaaagaaaattagactaacaccggtgttacgaagaatttcatttttagttataactagccacattgtcgttgtaaaaactataagaaaaattaaatggaatatattttttacaactgtaaattgataaaattgtcgactaattttgttattaattacttgtttttctacttcattttgacctgctagtgtattttctgcaatttttaattttttagaaagtctcaaaacattttttcaagcattgaagtaaaaaaatggcatgaaaaaaacgtaactagctgattttcaataagttttttctcttttgctgattaatctgtatattttaagagaataggaagccaaaaaataaaatggaattaaaaaatagaaaatcccaacaaagattgttataatcacaacctctttaaatttttcaaacattgtattatctaggccaaagcgaagaattaacgaaacaatagcaagtacaatcgagcaaagtcaaagaaaaacaaccaaatccttaataaagttaataatttttcatttaagtattaattgtcttgtagttcaatcattgccaattgaaattttgtctctaagtgacttagtaattaataaaattgaagtaattaaaggaataaatttaaaaccaatcgaatattgcttaacatctagcccagtttgtctaaatacttcatcattccttaaatttcaagcaaaaatgatacgcaaaaccaatgaggcaaaaaatgataatcaaaatatgctacctattgcggcttttaatcttccaattggtgtcgctaaatccaattgatttgttggtttgccctcaacatcgttaacactatataaaataataagtgaaataaaaattattgttttaaaaattgacaacaaaaaaactaatataaattttatggaattatcataattaaattttgtattcatttttaaattaattaaattacgcatatttacaccattttttaatatacacttatgaatattaattaattttccctatttacccctcaatataaattgtaataatagatgtaatttgctcaaattttaaccttgtcaaagctaatatatgcacttagacgtctaataccttcttgtactagctgatttataggattaaaagcaagattaataatactgttttttaaaagtttaacaattgctgatcgcacatctgaattgtttataaaattagctaaagaatcgaggcttgcatcattgatcgagttagatataatgtttttttcgttcatatacattgagtttaatattttggtggttaaaacgagattattcaccattccggcttcatagttaccagtagcgatatttgaataaatttcaactgcatctaaaatggtagggagttggttgaatagtgcccctagaaaatttaatgttacatcaaaaacagtagcaactccataaaggccatatcaaaatgccattggaaatcaatgatatcaagcttcttccagaacttctttatccttaaaatgatctttggtaaaagaaattaaattttcagcaaatttatttagatcttcttctgaaagatcattgagtttatttaattttacgagtttatttagttcaaatttgatagaatcaatgttttttttatcattttcaaaaacatatttaataacattattttttaaaatctcggtgcttgaaaattcattgctttgaatcttgatttctggagcaatttgtttttgttgtagtggtgcgattgaagtaaataataatggactggccaacgttgttagcattaatcctgatgaaaaaattttaaacttattcgattttataaatgagtatttcataattttcctccataagacttaaatattttgtataatttattatagcaattataccatatataagaattattataccatatataagaattatacaaacattaaatgcttaaaaaaatccttatttttactagctattttagtattataagccctttgtttttggctgtttcttgcacaaacattataattagcaaatctgaattatcaaaaatagaaagtaatatttttaattttataataaacgaaaatgaaaaaaatttaactagatttaccgcaactttagtaaaaaaaactaataataacttgacttttgtcagtacttttcattcgctaaattcaataaaaaacaatatacagcaacaagtttttgatatttttttacaacaatttagtgtgaaaaatttagaaactaaattaaaatcaaaaattagagttgaatatgaaaataaagaaaaagatatcatagttttttcgctagatataaaggaacccttattgttgagaatttcggattctattgattttcaggttctagaggattttacaaacacaaaaaatagcctatttagcttaggttttctcacgatcttaaacgaagattttaaacctaaaacattaaaaacattattttatgtaaatgacaaagttgttgaactggataaagaaaatgtttttgtccaagatatcaactacaggcaaggttcgtcaggttctcctctattttacaaaaacaaaattgttggtttgtataggggtaaaaaattaaaaaacggaaaattaacccccttttttagacttattgatttagctacttatcaacaaattaaatctgtagcttcaaaattaaaagattagaataaaaatattaattatttactaaattaatatattaatttattaatttcttagttttattagaataaatttttacccaaatagttttagcccataataaaaaaatatttaatattaggctatttttccaaagttgtaacctaataaaacttgcgactggccttgatattattaattctaccacaaaaaaaatcaaattccaatttttttttattttttttagtaatagcaaattaatttacaattttccatttttccttttataattatcctttaataggcaggcacgcccaaattttttctaacgaaaaggcattcctctttttcttttccttataattatctttgatattataaggaggaaattacttttttgaaggaaatttaaaaagtccatttcttatttgtttactttttaagctctttttgaatctatattacgtagtaatataaaaaattccaaaaaaacagaatacacaaattatatctaaaaatttaaactaagacaagattagctctatttttttgatggtgtaaacttaaattattaaaatatctatcaaaagaaaaagttgaatatttaatttttggtattaaactttactaaactagcaacaaaactttcggtataactacttgcgttttgaatgaaaaccttgaccttgcgtttgtttaactttttctaaaaactttgcatcttctgctttaattttttctattaaattattaattaaagtcgttttttcttcagctgtgtaaaacataattttttattttatattagaaatttttttaaaaagaagaaaaattttatgaaaatttaacttcttttcctttataatttaaatttattaggaataaatttttgcccaaagggggaattatggcaaataaagatcaaccaaaactaaaaaaatttagtccatttcaaactcttgtttttaatagtttggcacaagaaataaaagaaagaccggtaattatttttcacgataccgaagaaaattattactattatattaaagcccgcgatgcccgtttggataatggtagattaaaaaacccttttcaaggtgaaattttgattccaaaatcagataagcctaatactttatttacaaaagattcttatttagattgttcgcaaattttttatatgcgagacagcgaactagaagaattagttaaaaataacccaaaaacagaaatacttgattcaaaagaattagaatttgatcaagtaaaaaaaatgtttaataaaattaatgaatgtttgaaatctaaaccgccttttattgtaatttccaaagtttcttatgattcaaaaacaaaaacaactaagtccgaagttcaatatgctagtgattggcatttaaaaaacgattatgcccaagcaatagctgaagttgataatatcgaagaaattaaagaactcgaagaactaaaaaataaattacacaacgaaaaaaaccaattaaggttagatttatttgaaactgttttgcgggaagctcgaagagaatatagaaaagaaaaagtgtataaccctttatttgaatgaataacaaaaaacaaatttatccaaaaaggattaaacacaattgaaattattcatgaatataataagttatcaagcccattagtaccagaaacaattaacggcgatacaatttatatttgtttagttaataacaaatgggaagatagaagagattttagcttatctgaaagattagagcaaactaattttaaatctatgattgattgatttaaaaaaaatgatttggatataaatatggaatcatttaggcaatttcgtaagtcaatgcaagaatcacaagatttaggtgaattgttgtatttttataaattagaggaacagctgaaacaagatttatccaaactagaaaaaaaatataaaaaagatggaccaaaaatgaaaatgtaaaaaggagaaaaatatggaactcggtcatttaataggcgcgattttttctctagttttttggtctagctttggaatttatattaaaaaagttaagcaaacaaacaagataaaagcatttatttataaaacaacaaagcgcaaaagaaacttaacttatttttatcaataaagtaaaaataaaaaaagttcataccttacttagtcaaagtatttataaatacaaaaaagtagatccgcaaaaagtagaaccagatttaggccttgtatgtgattataacggactttttacaaaaaaatcaggagaaagtttaagaggaataccaagaaatttagatgattcaaattttatcggttatattcaaacaacaagtttttcacttcattttgcctcaagcgctttgatacgagctaaagcttacaatgaaaatgggttttgaattaacaaaaataattttcttgttggtttgattgcttttagcaccgctatttataaaataattgatagtgattgagtaaaaaattattctagcaaaaaccggcgatggctttaatcgttttttattagatctagaaacccaaacaagactagaacaatttttacttagaaatttattttttgtttcactaacaaatttaaatcatattcgaagtcttgaggatcctaaagataaagacaaaatttatttaaacgagttatgacttgataatttaaatcaaaagccaacattagctctaaatacattaagaaattatcaacgtagtcctgaagaattagaaattgaaaatttgtgatttagcattcttgaacatgcaagcacaactagcaattaccggtctgattttaaatatggcttataccaaattattgaagaactaaacacaaaaactttaatagacagcacaaaatcaaataaatactcttatgactatccagaattaaacggtaatatcgaagctatcaaacaaaaacttaaaaaatattatcttgaagaaattgctcctattttacttgaatatgaatttttaaaataaaataaaaaaaaagaaaaaaaaaaaaaaaaaaaaaaaccgctaagttagtagaaaaaattcagacaattagtttatatactaacttaactttcttgaaaaatttattatataataattaatatagtaaatttaattttttgaaaggaacagttttggttaaaacaagattttttagtaaatttaaagattttacttgatcacaaatttttgctttaataatattagcagctgctgatgtttttgttattgctgccccttattatttaaaaaatatcgtgcctaacttgcacacatatttaggaattcgtgaagaccaagtagcttctttgacagccattattggttgagttacacttgcaactcaactaccgggtggatttttatctaataggattagttcgcgtcgactcttatttattgctgtcttatcaacaggaattattacattttgatttggtataaccatcaaaaatgctcaaaacttaggtgaagaaagcgctttgactcaatataaaattatttgaggtctttgaggaatcacatcaactttaatcttttgaaccccactttgaaagctagtttcacagcaaaccgaccaaaaaagccaaggtcttgcttatgggattcaaggtagtgcaaatggtatagttggatttttcctagtttttgttattggtttaattattacttcaatttattatccagacaatcaaaatactaatgaaatcaatagcacaccttttgctgcttatacttttataattggtagttttttagtaattacttcatttttggttctcttttttgtcaaagagaaaaaaattgaacgttatactaacaaaattagtttagaatcgatcaagaaaaatattagccaaatttatgtctcacttaaaaattgaaaactatgaatgctttcaatttttgtaatgggaatgtatactttccaatcagtttttgcctattacttagttcaagtgttaaataatgtctttttagcaccgacaattttagttacaattcttggtggaattagaacttatggacttcgaggtttaattagctcttatgttggttactatgctgacaaatttagaagctacattctcattttagttttaacagcactgacaggaatttttgttattttaactattttacttcttaccttagctggaattcaagagcctggaaccccactatttatcttctttataatattggctacaattttattcttaattgcaggttctctatcatgagtaatggtaactcttagatttactcaagttgctgaaattgaaattggtaaaaataactatgcaagttcagttggaattctttcatttattgcgttttcaccagatgcttgattctatgaattatcaggatatattggaaaaatctatacaattgaaggtcaaacaaatacttcgcctttaggttatcaattaattttaacaatcgcattaggtgttgccttatttgggacaatttgtggattaatagtgtttttatacaatcgagctgaacttaaaaaactaggtaaaacaaattatcgttgaagggaattagataatgcctaaaaaacaattattaatagcacatcgtggttattcaggaatcgcacctgaaaataccaaactagcttttgatttagcatatgaatttaattttgatggaatcgaattagatgttcatttaactaaagataatagaatagttgtcattcatgacgaggatactaaaagaacagctggtgttgataaaataattgcaaatagcactttatctgaattatataatgatgatcatagttcacattttcaacttgagactcgtaaacaaaccattttaacacttgaagactttttagatctttatcttgataagtttgaagtaattaatgttgaaattaaaactgatcaaactgaatacattggaattgaaaaaattattgatgatttatcaattagatatggaaaagacttttttaacaaaataattttttcatcttttaatttttctacacttgaacgtatgtttaaattaaactctaaatatcgccttggttttttattttgaactaaaacccaactaacaagactaagcgaaaaaaaaattaaacaaatttgcaagtatctccatccttgagtggatttatatgacgaagaaccagcaatgattgaagcttttggcctaccactaaacttatgaactctcaaatcaaaagcccgctaccaaaaatatttagataacaaacatgtatatagtcaaataagtaattacaaatatagtaaagatattaactaaaattcaagatcaaattaaccttcaatttggcagtcttttaaaagcttttaattttggggtcccacctcatggaggctttgcttttggtcttaatcgtctaattatgattttattagaagcaaactcaattcctgatgttattgctttcccattaaattcaagaggtttagacctattactaaattcaccttcatcaataaatcctgagttattatctgaatacaatatcaaaattagcgatgcagataaagaataatttccaaaaagttgaaaaattttaaaaaataagcaaaaagcaactaatttttaccttttaaaacagcacaaaaattcctaaagaatttaaaccttgaagcagttttaaatttttaggaatttataataaataaaaaagagatttggctgaaacaatctcaaatttttttataaaaatttattaaaaatttgaattaaagcccgttttagataagcaattgctcaaaaatcaaataataatttactaaagtaacaaaaggtgaatttttgcaaatttagataaaatttagtcttaattatacaagtaaaattgaaaaattagaattgctcaaattttagcaatttaataaccggcttacgataacttattcaagaaattataaggtaaattaccgaaatagacacaaacattataagtcatattattataagtaaattcccaacttgcgttaatgagggcagcaaaatatcttgtcccattattgaggtataaatttttcccattgacggaatgaaaacaaccgaattaataaacaaaataaagagtgaaattataataatatttagccaatggtaaaagaaaatttgtcaggttttagcacttaatgctttaagaattccaattaatttcatttttgaatcgctcagatttttggcataaaacactgtttgaattagcaaaattataataaataaaactagaatagcaccaataactatatttgtaaatgattgtgtatttaatattgatttggatataccacctagagccgattgggtttcaaattctttgttgtttttagcaaagttttcaatattattagctaaatcatcatcaatattaaaatacagttttaatattgatgggtcaattttttctggcttattgttattaagattttcatttgttccattctttttttgcacaggtttgcctaattcattaaatttatgatgtaaaaagctaaaatttaatctatttaaagtagtcaaactacttataccaactacttttagatctacaactgttcttcgtaaagtagaaacggtaattttttgattgtttggttcttttatattaaattttgttgccagcgattttgaaattattatttcatctttgttttgaatatttctgcctaccaaatttttgttctcaaaaataaatctatttttaaaaaaatcactttcatcaatatagtcaacagaagagtcaaactctattttatcgccataagagaaagtaaccttaggaaaattaaaaaaaggaacaatttttacaatttttgggttattttctttaagttttgtgatttcatcagttgaaaatgctcctatttttccatttggttttttgtttattacaaccgaatctaattgatattcaatcgttttttgcaaattagtgctgctaatatttaaatttaaaaccccaaataataatgtcccaaaaaaacttgttaaaaaaagcattaaaaataaaatacttgaagtaaattttgatttaaaatctgtaattgttaataaaaaacctgttttaaattcctgtttaattttcgaaagttttgaatttttagcagtttcttgatattttaaatcgctgtttttagcaattagcggttgattttgactatttttggcaaaaatttcctcagtaattttgcttgtttcaatatagacaattttgtcggcatatttttttgctaaatcgaggttatgactaactactaaaatagttttatttttggcaatattagttaaattttcaaatacaatttttgcattttcaatatctaaatttcttgttggttcatcaagcaatataaaaccacaatcacgtgaaagtgaacgtaaaattgctattctttgcctttcgcccccagataaattatttactttttgctctagttgttcagtttttatcgacattaaatttgcattttgacttaatgcatttttgtctaaaagtttatttattacattatttcctattaaaatattgtcattagatgtaattttttcaattaaattaaaatcttgaaaaacaacatcaactaatggttttttaatttcagaaccattttcatcgaaaaaagaaatttttccactatctttttttgtaaaaccggcaattaaattaataagagttgttttaccgattcctgattggccaactacaaaagtcactttgtttgaaggaatttcaagatttagtgaactaaaaataaatctattatcaattttttttgttaaattttgaattttaatcatttttcctcaggcctaaaattaaaaaacttgtaaatttttttatataaaaataaaaaatcacgaatgtgattttagattaccttaataaagttgcgacatcttttcgatatgttttataagaaattaataggtaaataaatgacatagaaaaaaaactaattaaccaagtcaaaagaaaaattacgataatttgtaaataatcgggctgaaataagttttgatttagaattattttgtaaaattccgggacaatcaaaattgataaaacaatacctacaaaaaatacaaaaacactaataattattaaatttaatcaatggtacatgaaaatttctagcgttttgccgcctagtgattttaaaactgctatcgattttttcttaaaattagaaagatttacagcataaacactaacaaaaatcaataaagtaataccaagaacaataatcgatgcaaaaatagacataattaaggtaaattgggaggcaaagaaaaactgccttacttcatcaggtccgccagaggtgaaataataacgtttgacaccagatttaccatatttatctaaaaaatcctgaatgttattataaagattttcttgattaaaaaagactaaaaattcactaggatgtacatggttgaaaaaattttcaatttcactattaaaaattactatattctttggttcttctgaagcattattagtagttttatcagcatcaaaaataccaacaactttaaaaatataataactattaaaagtagtattaatttctattaattttccaattttattagtaatattagagctaactgcaatttcatcaaatgaccgaggtaaattacctttagttaaatttattgaatttgcctggcttgaattttgataaaaagatttgctaatagtcggagtttcaattgtcgtattaccacttgcccttcaatcactaaagtcaagagaataaaaattatctggtaaaatttcgaattgatgaaaatttttgtatgattcttcatatcccttttcatatgttgtctttaatttatttgtatgaattaaagagaacttaggctgatcataatttttttcttcaattactccaacaatttttacttcttcaaaatggttagaataaaaaatttttattttttttcctattgggtttgagatttcaagttgattaataattttctcaggtaaaataacatcgtcttgattagatataaaattattattaaatttttggcttttaataatgtcagcaaatctatttttaaaaaaatctgactcatcaacagggaaaattgggcctgttgaaacttttttatcatcataactaaatttaaatgattgtaaatcagaatatattggtattatattctctatttttgggttttcctttttaagtttttctaattcattaatatgtaaggaggcaagccccttttcgcttacgtttaaggtgtctaaattatattgaacaatgttgtcaaaattaatatttttagcagaaatatttaagttaacaaataaaactaccccaaaaatcattgctaaaaatgagaccaaaacaagaataagagtagtaattttcgatctaaaatccgcaagagataaaagcaacgcgactttcactttttggtaaaaagacggttttttatatactttattttcagaattttctaaaaaattattcgtagatttttgaagatttttttggggtttgtctttattttctattgatttaatattttctttttctacataaataatttgatcggcatatttttttgcaagctctaaattatgacttaccactaaaacagtcttattttgcgatattttaactaacaaatcaagtaatgcaattgagttttcttgatctaagttcccagttggctcgtcaagcaaaataaagtcggcatttcttgatgaacttcttaaaaatgcagctctttgcttttcaccacctgataaattcttaactaatcgatttaatttttgactatttatgttaattgcactagcttcgttttcaatttcgtgattttcaacataacgatttagaatatgatttgcaattaaaatattatttttaattgaaagtgattctatcaaattaaaatcttgaaaaacaacatcgaccaaaggattttcaatttcattaccatttttaaaaaaagaaatttttccactatcttttttagtaaaaccggcaattaagttaatcaaggtggttttcccaatccctgattttccaacaataaaagttattttatttgatggaatctcaagatttattgaattaaaaataattttattgttaaatttttttgataaattttgaatttttatcatctaaataaaccttttgctcggaattaaataattcaataggaactctgcttatatttttaggccatactatgctaccattccctcttctgtatcacaattcatcctcatcttcatcaacaacatcaggcaaaaacggatcattagattttattgagctaaactcattttcatcaagtgcataaccgcttgcgtattgaccaaatccagtaatttgatagtttcaccctgcggcatgataattaataaatagctcacccccttcctttttttcaagggaattaataagttctttagtatgagtatcaatgtgtaccgacatatttgtcatacgggtcgctccctcggtaaaaactccgctatattttgtttcaccgttaaattcaaaagaaggactagcataaccgccaattcaagaattaacagatagttttattttatctacagtattatctgtgttgttttctcatcaatatgaatttcttttaaaccaaattctagctttacccctccattcaactttgtcttgtctaaaaaaaccaccacgatatacaattttttttcggccatctattttaatatgtagctcacctttgttagtttttaattttttgtgttggcgatctcttttagcgtttaccgaaaataaagaaacatcattatttcaggattgttgattttgatatgaaaattcttgaagtttatttttataattattgctcgaaaaagtttgagcttgtattttattattaccgttattaccgtcatgcataacaaaattactatgtgttgaagttgttaatgcgaatattgaaaaggatgcaattattaagcctagtagtttagattttactttgttcattataagtcacgcatttaattaataaaattataacaaaattttagttttttaaatacatttatttattaaatgaaaaaaaatttaaaaaaataaaaaatcaaatatttttaaaaaaaattagcagaaagaattcagacaattagtttcttatctatgattttgattacaccacttttgttaattttttctagtatgttcactttaaaaaaattggacaaataatttacctcatataaaaacttgggcttttatatgataagcaactttgaagtctttcattgttataccaattaataaatgaacttattttttgataagtaatagttatattttcaaaattttgatgttcaacattgattaattctagctgcaaaatgctatgagaatttaataggattgtttaaaaattatactaattaaaattgaaaaatatttagttatttgttatataattgtataattgtataattatataattaaacaattaaaactctcacaaaataggaaaaataatgtacagaaaaaaagcaaaagccaaaccaatatttttacttggggttggtattttttcacttgttgttgcctcttgttcaacttcaaactcaaatccatttcaaaattatgtcgatccaaatcaaagtcttccaaaaaatcagatagataatttttttcttcagtatcctaattttcctgaagctattaaaaataaaataaaagattccttaaatatttcctcacaaaatttttcaaattcagaatatttgcccaaactttctcaatttgtagaacaatactcatcaacattagttttgtttcaaaaattcgagtctaattttaaatctaaggcaattgataagtcttttagtgttaacgaggagaaatacaataatttaaaaggtgaaattgaatcgtttaatcaaaaaattctaaattcaactaattttgaaactaaattggatgagtttttaaccaaaataagccaattaagcgcggaaattactaaaaccaataacacccttagtcaggaattttcaacttttagctgatttaagacggttttaaaacatgcaaaccttgttaatcttaaagccttaagtgcgcaaattaataacaaaattaccactttatataaaaatgataataaagaagaaattcaaaatttcacctcaaatttactcatattggaaaatattattgcgcaaattaaatcaataaaaaatgaatattcaactgagagcaatgaaattttcaataatttaatcacaaattttaattcaaatataaattctagtagcttaattaacaatgtcactgattcaattagaaactttaaaaatatccaaaataatttagaaaaaattgttaataagtcagcacagaaaaaccaaaaactacaagaattaaagaaatctgctattttagatgttgagaaagccgctaatttatcccaaacagttcaaagtaattttaaagaaaaaataaataactcaattgctgaatcacaaattagtcaaattaaaacatttatttcagaattagaacatgttgcaccgcttctatcttcattgaaaacagaaaaaacaaggctagaaaatgagcctaattatttaaattctgaaaataaaacagaattagatgatctaatgaattccttaaatttattagatcaagaaaataaacttgcattaaatgatgaaatttccactaatacaaaatattttttatctaatgttttaacagtcaatgaaaatgtacagtcagaattagcacgtcttaatggtgatgctcaattaaaagaagctaaaaaaagcttggaaaatcaattattatcgaacaaatttagcccaaattttatttctaatattaaaacactggcagattcaaaaaaattagtttctgatattaagcatataagctccaatattttaaaattagcagattctcttgatttgtatagtgttgaattgaaaaattttcaatctttgttaaacaactcaagtacatctataacaaacaagcaagaacttgaagaaaaaaataacaaaattaaacaaaaattagaccaagatcaccgactcaatggacttgataatgaaaatttggccacatttgttgatcaatttgctaatttagtcacttcattttctcaaacaattttagattcaaaaacgcaaaattaccaaattttgcaagaaaaaacaccagcaaaaattgtagaaaattcatcagattttaaacaacaagcccaaaatgccctaaaaattagtcttgatgaccaaggactagacaatcatagtataaaaaaatatcttacttctgcttcttttaaccttcaaaatgcaaatctttgattaaaaaaaccacaaaataatgaaataaatttcaaattattagacttatcactagatactaacaacagaaatattttagtccttaaatatcaggcgacttcaataaaaaaccctttacattcaacaattttatccacccaacttttaattcctaatgataatgttgacataaatgcgataatctcttcattaaaaatagatcttcttgatgactattttgatattaagtatacttctttccttgattttgaaaaagaagggtttctcaagcaagaagtaaaaaaatttattttagaaaatttttcccaaacaaaacaaacaatcgaaaaatttttccatgttgtattaccagagcaacctgaattaacctttaccagtgataataaaatatctttaaatttagatattaaatttaataaccaagttattaaaacagtcagtgctaaatccaagaatcaagttaattttaaacaaaaagataacttgccagtaaaaattggatatactcaaaactttaaaaacaccagtttttataatcaaacttaccttagcgattctgaatatattgattatgattatacaaggtcagatgattcatcatcttatttttggggaatcgaagagccttatggggctggcggacttggaagttattgattttataaatatttattaaaaccaactttagaaacattgcaacaagccggggagattcctaaaaataaaaaatttaaaacttttgaaaaacacccaaaagttgtaaaagtttcagaaattggtttagaaaagccaacacaacaagatgaattaagtaaggctgagcttgataaaatttttgataaaattttaaaagatcaacatttttttacttacgaaattcctgaaaatgccacaatttcgttttcaacatttgatgttggcaaagaaaaaagaagagttttaacctcaagtattacccaaagtatttccctaaaattattaataaaaaatgacaaacacactagagaagaaattctagaatttgcgcctaaaaattacttaaaaccaactttatcaccgcgtgataaagctgatttatcgttaattgaagaaattttaagcgattctagtggtaaaaaattatttaaaaacacaataattaacgatattgattacacccacggtcaaatttcgctagccggaaaaacgaatttagaaataatagactcacttaacaagctttatacatttggtaaaattggaaaatttgaaatttttgcaaaagaagttatttctacagacattttaaaaggtgaggcaaaaattttcttttgatataaatttaacggcttagaatttccgctattttttaaaggaactaaacctattagaactatcaaaactgaaaaagccattagtttttcaaattgattgccacctacttatagtgatattaaacctaaaaatggttctaatttcaccagtgaggattttttaccaattccagaagaaacaggtcaaataccaataaggagccaaaccttaaaatctaatcagattcccaatgatcacaaatcaataattgataatattaatagtcgccactttgattatcgtagagtaagcgctgaattttataaaaaagcgcaaaaacacataaaatatagactaattgaccctgctgatattgttgaacaaaaagcggaatcaaagttaaattatctacttcaaattagaactaacaatgacagtgttaaaaataaagatttagataagtttaaaaatgaagaagtcaaacttgaagatgaaaacaaaaaaactgaacaaaatagtgaaaatttaccaataattgtcgaaaagcaaatattttttaataccgatcctgaagttagacttgatacttcaaaaattttaaagaattattttgtctattattatgatgttaaaaccactgacaaaccaggggaaatgacttttaaacttggttttattaacaaaaataacacaaagatccgctatagttctaataaagtcataaaattacaaaacttagaaaacgattataaaaataaactttatcctgaaataattctaaatagaatcaaatattctgattttgttcccaaaaataatagatcacttataacaaaggtgttaaataacagcgattttcaaaatttctttgaaatcaaagaacaagctcttaagtataataattttaaaatctcaaggcaaaatttgcaatttcttgagacaaaaaaacataataataaattatatttccgtctaaaatatgttaatggaccacatattgttgaaggatcgacttgatattttctaacaaatataaataaccaaaataatcaagccaatatagatttggacacacaaaagccattagttactttatttgactctgaaaaagaagtaactagaagtcgtgaaattgaaccttattataaagatttattctgaaattacaataattctacaaaaacagctaaatgaatattaaaagaaaaatatttttctcaaacatttttaaagaataatcctaaaaaccggaaaataaaactacaattatttgcaaatgctttagttcaaaacacccaaagacttacccgaattagtggcggagttgacttaatcaaaaacaaaccaattaaaggcggttatgactttatttttgactttgaaaaattagtaaaaggccaaacaatagcaattactgaaaaaaccaaaaatgtattttttgaagatgcaaggaaaaaatttgaggactttagctttactttaagtgctcaatataacaaaaatcaagggattgaatttaaactatgactaaataatccaaatcttggtttaatagtcgataatgttttcaatcatgttgaaaaaggtcttgccttttataatagcccaaaatttgacacttttgatccaaaaaaagcctttattttacataatgccggagcaagagttcatattgaatacacaaactcgcttgaaaatgaagattttggttctaaaacaaatcaatttgattataaaaatattgactacactaatgaagagcagccaatttcattttttaccagttcagatgtttacaatttagaaaaatataatccaaaccaaaatgttccttataaattacatgaaggatatttacaagatttagactttttacatacatcttgggatactaacaaattcccactggcaaaaaatttattagctagaacctttggcttttcttttggaagcgcaactatgcttgcaaaagtaaatgatgatccaaatgatggtaaattttacataatcacaaataatcatgtcgaaggtggtggaaattttgatttaaattctctttttggtaaagatttaactaaatttttattaaatactcgttacatggctattggaagtaaatattattctaattcaattcaaggcggttatagctattgaggtggacaaaatagtgtcaaaaaagttcctacttgattagtttgaaccggtactaagcagccggatgtaaatcaaaaaaatccaaaatttgttgacatatctgttttaatagttgatattaaacctttaattcaagcagcttatgaaagtggtgagttcaaaaaagcagcctgattattaaattgatataaattacctaacttaaaattaaattcaaatggtcaatcggatttaacattttttggtcaaaatgttaaacattttggaatgaatggatttccttatgcaaaacaaagtggttatataataaatagggctaattcagatcaacaaactgtttatattttaaatcaaaaaggttatactccaacatattttaatgctggtaattccggaactggagtattagggctaaatgatgagtatatatcaacgattaattcaggttcgccgcttacatctttacaaagttggaattattcaacagcaagtcataattattttggaataaattgacaaaatgaaaaacctcttgaactaaaaaataaatttagtttatcatcgatgataatgagacttaatgctcaaaatccgcgtgaatataatcttccctggtttttcaaggattttgaaaaataaaataattttaaagtctaaaaaattagtttattaatttagtctatttatttaaatttttctatttttgctgattttattgccattaaaactaaaaaattcaaaaattaatttagtctagaaagtcataaaaatttgaaaaaaaatactaaaaaaagagtaaaatttacttttaaaagataaaattaagtaaattttacttcccaaattaaaaatatctgtgtgttgcttttatattttgaatttgggaatatataattaataaatgtataattgtatatttttttattgatttttcaaagaaaaaaattattctgctttttttgaattatttaaaatagtttttcgagcattttcaggtaaagatttgccatattcaaaataatgaccaatttctttaaatgcgtttttacttatttttaattttgcaaaatcttccggctcaagacttaattttattggctgatttttctcaattttttcaacaaaatcaggatcaggcacaaaggctgaagaaattccgataaaatcagcaaattgaatagctttaactgatttttctaaggaatttattgaaccactagcaataacagggatttttccttgcaatttttcataaactacatcagaaattaaacggttaaaattatttgattttgaccgaactttgtcacgaaaaacgtcaaaacctcaaccggcaattgcaaggtaagaaatttttatcccccttttttcaattaaatctaagaaatctaggaaattttcgactgtataacctaaattatcgcctcttcgttcctcaggtgttgcccggtaacctagcaaaaaattaggattttttgattttaaaatagttttttgtactttttctaatatttctagcaaaaaccgagatctattttcaatattttgacagccatatttatcatttctcttgttagtataatttgagaaaaattcttgaggtaataatttttgggccgaagaaatttcaactccatcaaaacctgccttaattgcccttagacaagcatctgcatattgtctaacaatggttttaatttgcttttgtctaagacgataaaccttgtattttacaggataatttcgcttttcagcactaggtccatagcaaaaaccatctttttcaatttttgaaacagagtgagaaccagcatgaattaattgcaaaattgcgatacttccttttgattttattgcctttgcaagttttgctagaccttcaatatcgcaatcattttcgatactatgaccatatttgaacaaactacctgatttacaaatataaactccccctgtaattgtcattggtgcactatgggctctagcgctaaaaaaatctaaatctgcttggcaaacttggcccatttcagaaagattaagattaattgggctaaaaacaaatcggttttttaatgtgaaattaccaatttgatacggtttaaaaagtttatttttcatatttagtttaaaagtaagttacaaatttcttcttcatcaattttttgactaaaataatcttccaattttgcatcttttagccgatttaatagttgatcttgagttaattttgtccccattaagaaattttctaactctaaaagcgactttttcgggaaaaaatcacctgaaattttaattttactaatttttccttcattaatttctaaagaaaatgttattgttccaacttttgttctaattgatctattgaaggaataatttgggctaagtcctcaaacaaaatcccaatttttgtatttttcagcgaccattttgtcaatttggactcaatcgctatcagtaagctcgtattttttaaacttttctactgaatttactttcaaaaattcggtcaaaaataggtcttttatttcaaaaattgaaaaattttgatattcttttgaaagcttattttttaaattagttacccgttgagaaacagattttatcccttttgcttcaatttttttctggtttggagttagaattttgccaataaaatcaaaatctacatcatataaaagtgaaaaacctgcataaattctatcatttacaagcgacattgccgcaccagaaactttttttccttcaatttgaaggtcattttttccactaaattgcacattttttatccctatgttttgcaaaactttaataacaggatcgtaaaattgtgcataatttccgagtaaatttttatttttttcatatggaaatgaaaaacaaaaatttactccatttctatctaaataaattgcaccaccaccagtgtcgcgtctaacaacttcaatatttttttgctttaaaagttcaaggttaacttcaacacttggattttggaaataaccaatttgtacatgtggatcacaaatataaggaaaaacaattgtttcatctagttttaagtttttgattgctcaatattgaattgcaagcaaaattgctccgtcaaaaactcattttccattgcgttttggttcgattaagtacatttttattcctgttctgttattttttgtagaagtaatttaatatcctcatgaaaaaaataggatttttcaagaatatccttgttagtacggtattttttctgatttataactagatattttgcatttttgaatttttttgtcatctcttgaaatggcaatttaattaattgcggggttgtaaaaccgacccctatttcaagaaaaactaattttttatctttattttgttcaataaaattattgtaatttgctttttggttattgaagttttgatcttcaaccattcctttaaacgaaattcttttgtttatttctaaaaaggcattacattttgggcattttggcaataaattataatcaaccttcatatttttttgattttctaccatttttagaattaattcatcatcttggtataaaaaatttttacacatttttgagcactgcattaaattatatttgccctggatgtaaaaaattttttcattgtcaaatcctgatttttcgaaaaaactatcagaatttgtggttattataaaaaaatttttattttctaaaatttttcttaaattcaaaaaactttctgattctttaagatctaaaaaattaactttcgcaaatctactatgaaaagctcagtatgtttctcatgatccaaaatcataaagcgaagcttgaagcatatctaaaaaatgatatttttcgataaaatctttaaaattatcactaaattttgatccataataattatttccatctgcacttgttagtcctgaaccaactccaacaacaattgcatcagctgaatcaaggattttcttgatttttatcgcttgatctagaatactaaaagtcctcaagttcatcaaattcactttggtctatatcttttgctttaaaaagtcaatttttgtctgaatcatgtgaattcaaaatttttggatccttttcagctaattgatttagttcaataattctacattttaagggtgtttttattgaaaaaacagtttttgacgcttcaattttagcgacaacatcatctttttctagtcgttttttattggtaaattttaaaaatccgattgttccaagatcatcttgtaattcggccgttaaataaatagtaaaaatttcatttttttgttcaattatcaagaaattagcaatttttttcatagcaatcctcttaaattttttgttaatatctaaaatgatgttaccacaaaaaagcaactaatggcaaaaaatctataaattataaatatagataaatcagttaaaaaattcgataaattagtacattaatttcaaaaaaatcaaaaatacagtgtcaaattgaaagaatggaaaatcacatttaaaaacaaaatatttaatattcccgacttttttacaaaattataaaaaattattgtagataaaattaaaaatcagcatgctctaattaaataattatttacttgcttagcaaattatagattttaattaaaaaattaatttggaatacagaaatattttgcaaaaatggtataatggtaaaaaaacattattgacaattatcattattatttttcagaaaagtacaattatgattatttccaagttaaaaaaaattttaggcttcacacttattggccttattcctgtaacatttttttcctatagtagcgtccataacaacataaatttaacaaacgaaaactcacaacctcaattattttcatattatcattataaaccagacaaagcatgaagagcaggaaaagcatggggtattttacaagaacttcgctgatcaaatcacaagggactatctaaaaacactgattactttaatccagaagatcttgattttgaagataatcacaaaatcttaataaccgatcaaggagaattagaaattcttattagaggtgttaaacaagttgtatattggggcggattattttggcaagataaagctgcgtgaataggaagaacggaaattcagtacaccaaaaacagaaatttttccaattattataattataatccagatcaaattaatttaaagacgcatgcttgaatttctggactagctaccccgtcttttgtaataaatggtaaggtagcttatgctactgaaaaaagggaagtaactgctgaaattggtgcatcagcaaaatttgaatttaattcctatgaattaatagaaacttttgaaaaaagaaatgctaatagactagtaatgaattatcaaggggttggatggaattacaaaatatcagattttggtcaatatgcaaccggattagtgatagatgactatgaatatacttcaatcgcaacaaataacccgctaattcccgacaaaaattcaaattatagacccaccatatacccatattatatggacaaaagcaaattttaataatgataaaaatagaaaaattaactaaaaaaattggtaataaatttatttttgataatttaaatctggaaattcctttaaataaaattacatttgtaattggaagatctggaattggtaaatccacactaattaatttgattgccggatttacaaaaaaagacagtggaaaaatttctttttttgacaaaaatggttctgaattggaaaaaccattagttgatgttgtttttcaagactttaatttaattgactcattaagtataaaaaataatattttaatagcaaatcacattttgaatcgtgaatcagatgatttagaaatacaacaagccgctaattctattggtattgaaaccaacaaattagatcagatagcgaaaaacttatcgggcggcgaaaaacagcgagctgcatttttaagaagtttatcaagaaaaagtgattttattttgcttgacgagccaactggtaatttggaccatgaaaattccattgctttactcgatttattagttaaagcttctgaaagtaaaacaattttaattgttagtcatgatttagaattagcaaaccaatatgctgatcaaattattaatttagaaaatttatccgttaatgttatagaaaacaataaacaaattaatgttgaatcaaaaaataaacacttaaacctaatatcaaaccaggtctataaaaaacctggtttcttacaaaaatttaaagtagctttattgcttgtgctcgccgattttaaatcaaaaatcacgagttttattttagttttagtaacattttttgccttaatttttagcatagttgttttcatgaacttacatttttcagcaaaaaatatagtcactgacacgcttgcccaatcaaattttgacgccattagaattggagaaaaggatattatttctttagtccctgaagaaatcgaccaacttaaaaaggataatcccaaaataaaacacactagtttattatatagtagacttcaagattatacattcatttataatgataacgtttctcttgagaatcgttctattagatcaactgatgaatccgatttttttaaaaacagatttagttcatttagtaaaaataaaaattttaataacaggtttattaccaatccaaatgaagttattctctcacaaaaattaattgaagaattagaaattgataatccaattggaaaaacaattaaaattgttcaccttaatcgattaactttagggaaaaactttgaagatttagatcccttttctgaatcagcaacaattgtgggaattttggataagtctcttgataatggcaacaatttttcgcttgttcacatagataaactaaaatcagtatatcaaaaatcaaatccaaacgaaaaagaaagtaagtttgatgaatttgagtttttacctgatgattatttttcattagactttttagggtatgtttctagtagaccattaaccgtagaaactgacgagacacttgcaaaacccaataaaatacataagtctttctatgagaattcaaatcaagccaattcaataaacttgaaaaaaggtacattgcctaaaaattttaatgaaatagcagttagctcgaatataactgacaaaacaggaaaacttttaaaaatttctaacaataaaaatactttaatttttaaagttgttggagtttttgatcctgaaaaagatgacgaaaatattgctatttttaacaataatattgaaaaatattctagtgaattacttccaatagctgctgtggtttattttgatcatgataatttatataataatattaatgaatttttaaataaatatagcaaaccgggcgttagtcgttattactcgacaaatggcggtccggatcaaattctaaatcgagcaattaactctcaatatgttttgttattaattatttttgtgtcaataataatttttggaataagtttgttaatttttgtgtcattatatgcaacaaatctttctaaattcaagaaaaaatcaattggtattctaaagtctcttggtggcaaaacatcacaaattttcttgtatcattgattaaatttggtaatactttctgcttttgttttcgtttttggtattatattttcaatttcttttgtgcccttaatttatggtgcaatttcaaatcaaaattcagtttttcctgattatctgcaaattagtgttatttttataattatctggtttgctagtttctttattttatcaatcatatattcattaatttcttatataacttataaaaaagatattgtgacattattaaaataatttttaaaaattattaaaactaatattttttttatcaaaagtcttaattttataatgttaaataagaaaaatacagcgaacttggagcaaaatgataaaaattgagaatttaactaaaaagattgataacaaaatcatctttgatagtctaaatcttgaaataccttcaagaaaaataacatttataattggtaaatcaggaattggtaaaacaactcttattaacttaattgccggttttactaaaaaagatagtggaaaaattacttttttcgataaaaatggttctgaaattaaaaaaccattagttgatgttgtttttcaagactttaatctaattcctaagatttcatcagaaaataatattttaatcgcaaataatgtaataaatagagttttagatccaaaagaattggaacaacaggctaaatacgtgtcaattgaaactcggcaattaaagcaaaatgtaaataatttatcaggtggcgaaaaacaaagaatagcaattctccgttcgctttcaagagatagtgattttattttactcgatgaaccaactggaaatttggattttgaaaacggtatttctgtatttgaaaatctaaaaaatattgcaaaaaataaaacaatattagtagtcagtcacaatttagaatttgcaaaaaaatatgccgacaaaatcattcgtattgaaaaaggaaaaatttccgaagaaaatattgacaaaactgaggaaaatttagcaaacaacaatgaaaaaaatagtcaattagtttcttttaagagttcttcctattcaaaaattgcaaaaattaggcaagaattaaaaacaggtttattccttactctggcagattataaatcaaaatgagtttcaaccattttatttgtaatactttttctaacaagtatttttgggacattattatttgctgttttaaatttaaatatttccgcttctaattctcttaaagttaatgaatatcaacttgattctgttttagttagcaaaaaatcagaaagaaatttgacaaccttcacagataatgaaattaataatctcagagaaaaaaataaaaccataaaaaaaattactcctttctttactttgccatcattaagttttgaatataatgacaaaagaaggttaggagcacctattgattatattgatgaaagtgaattttttaaaaataggttcaattttgatcaaaaaaatttaattggaagaaacattgaaaaattagatgaagttataatttcaaaagaattagctacacaatttgatatcaaagaaccaaaagaacaagaaattgctgttttaactggccccaaagataaaaaaacattaaaagttgttggaataaataatttagttaatgcaaaaaaattaaacctaacttttttacatcataaattcggtgaaaatatcgaattacagaaaagtaaaaacaggaaaccagacaattcacaagccagtcaaattaaaaaaatagaaccaattattttaaggttgtattttgaaaataataatttggaaaataatattgataattttattaagaataataaagactatcaaattgactcctcattaaaaggtataacaaaattaacttatgatttacaaaattttataaatttaattgttggagcaattttaattgtttttatagtagttttgttaatacaaacgattttttatacaaaaaatctaactgattcaaaagtaaaattaataggaattcttaaggcgcttcgggctaagacatggcagatttttctttatcattgattaaatataattataatttcatttctaattttagtcattaacttatcagtgtctctcccgttaattccaaaaatttacatctgaatactcggtgaagatgccatatatccttcgatttcacagatagtaattttaattttcataatatgaatagcaatgttttttataatttcgtttatttacttattgatttcatggtttaattataaaaaacctgttacaaaattactaaaattcgatcatttttaacgatcatttttttaaaaatatataatttactaacaaatattttttttaaaatatttggtattttatttttttagttttattctgtttagattcccttaatagccggaaaatggtaaaatattaaaaaataaaattaaaaggtctaaaatatgaatcaaaataatcttttagaaaaatacaaacaacaaatcgaggaaatttcctcaaaagagctaaattcagaccaaaaaaatttagcaattcaaattttagaaaaatttgaaccaaataaacttgaatacgtttttcagtttatttctcaacgaatcaaaactggttttcgttttgatgcagctcctgaatctgattcagatttagttgcaattttacaaaaaaatgaaaatttatcttttgttttagacaaaagtcaatctgaagaaaatactttaataattggcgaaaattatgatgctcttaaaaatcttttagttctcgagagagagagagagagagagagcggctggttatgatataatttatattgatccaccttataatactcaggctagttttaatgaaggtaatcaggttgcaaatgataaagaaaatattttaccttcaaaatttatttatcgagataaatactcgcgaaatggctggctaaatttattaaatgaaagactaaatttagccaaaaaacttttaaaagaagatggaataatttttatctcaattgatgataatcagcaagcttatctaaaagttttaatggatgaaattttcggggaagaaaattttgttgctaatattgtgtgagttaaaaaaaatagtccaggtggaaatactagttttgattataaaataacacaaaacacagaatatattattacttatgctaaaaatttaaacaaatgtaagttcaattaccaaaaatatgatgaaaaaactcttaaaaaattaggatatacacttaaagataaatattttgaccaaagaggttattataaattgactgaccttcatcgtacatcatctacaggcgcatttcaatatataaagtctttggattatcctattattgcccctgatggtactagttttactttgtatttaaataagaataatcccgaatcagcttgttatacttgagggaaagatacttttgtcgaaggggaaaaacaaggatttattgaaattgttaaaaattctcgtggcgattgggttgctaaacgtaaacagtatcaatatgttaaatttaatccaaaaactaaaaaaattgaagaaattgtcgctggtgtaccgtttaaaaatattattagtgatttttattcattaaacggtggcctagaactcaaagaaatttttaatagtaaaaatatctttgatttccccaaaccaattgaattaattaagtatttaattaatattcatcccaataaaaatgcaaaaattcttgatttttttgccggtagtggaacaaccggccatgcagtttgagagttgaaccgtcaggatggcggaaacagaatttttactttagtcacaaacaatcaaaataaaattgccgaaaatgtaacttatgaaagactttttagaatttcaaatggaaaaggaaccaaaaatgaagaatttaattgaagtaaaaataacaaaccttacttggaaaatttaaaggtttttgatatagtttattataatactcaaatttttaactcagaaagtgaacttaatgatttggttaatttacttttaaaactttttaaagattttgatattaaagttgacttaaatcatatagatactaaaaataccaggtatgttgaacttttaaatcatcttttagcactaaaaccacaagaaaaggatttataaaattatggaattaacgcaatctcaatctaaagcggttgaacaattagttgaaaaaacaactttatatctgactagtagtgaagaaattgagccaaaattagaaaatgataaaaaccaaacaaatccagcaaaactaaaaaatgcaatttattttaaagcgccgacaggatcgggaaaaactttcatgattctaaactatattgataaattaattgaatgaaataaagcgaaagttggtaaagaattagtttttgtaattgtaacattatcaagtgctgaattacccaagcaaatggaagaaagttttaatgaatataaaatttttataaaaaatacaaatttgaatatagagagaattgaaagtccttcaaacttgaaaagaacggcaaaagttgataaaaactatgaattttttgccaaacctgattcagtttttattatgggtggcgcatcttttaaatcaaattctattttacgtgaacaaggatcaattgaagcatttttgtctgaaattaaacgaaaagggcaaattcttatttatataagagatgaagctcatattggttctgatattaaaattaatttaaaagacaaaacttttgaagaaaaaatgcaagaaaatgcatcatttatattaaaaatgacagcaactccaaaaactgatttgccattagttcatttatctgaaaaagatttaagtcaagatgatattcaacttttaaaaactcaaaaacatcataattttgacttagaaaaaggtgaagattatgatgatgaagaaattttggaaatagcttgtaaaaaatttaacgaaattaaaaaacaatataatgataatattaaagagcctggtttagtcggtattaaccctgcaatgctaattcaaattgataatagtagtgaaaaagatgctcaaaaagcgcaaaaatttgatgaaaatattgaaaaaataattaaaatactcgaaaagcatgatcttagttgggtcaaatattttgaccaaaataaaaaagaaagtaatttgcgccaaaaatctaatttcacattacgtgatatttctagaaatatgtcttcagttgatgtaataatttttaaaattggccctgcaacaggatgaaatattccaagagcatgcatgttagtccaacttagaaatatttcatcttctaatttaagtattcaaacaattggtagaataaaaagaaatccttgccctatgtatactttaaaagataattccattgctcgtaaatattttatttatagtaatgttgaccctgagagaaaaaatgtgcttaaactttatttgaaggaaaaatataaatatgacaaatttatatgaggccaaatccaaattcccggaatgcctgacgaaactagaagtaaaataattaattataaacaatatgaaaacgaatttgaacataaatttaacgataagaggcagaatcaggttaaagaaatttttaaaaacgatttgagaaaatatgaagacgactataaggccaataaatttatttctattgatactgaaaaatatggttcagcaagattaattaaatcaaaaatttccaacattattgaattagaattagcaattattagacttaaaaacaatttaaaaaagtattttacttccaaaattgaagacttttttgctaaaataaaacaagattttttatcagatataaaaacaaataaacaaattttagatttaattattttgttaaaatacgggccagaacttgctaaaatttataaaaaaacaattaaagaccaagtcaaaaacgctcagtataaactttttgaagaatgtttacctaaagaaattgaatttaatagtgctgaaaatgataaattggtgaaaactaatgattcttcttttgcttataaaaaaattgatgacaaaacaccagaagataatcttccattagattcagaagcagaactgttttttgcaaaagaattaataaaaattagtaaagcaaagcaaaatattcatttttgagctaaaaacccagtctatactaaattaggttttcaatacattaacggaaatgaaattgcaaaatcaaatcctgattttttggttagcaaagatggaaattatttttattttgagatcaaacattataaagattttgatcctgaaaaaactcaattattaataaggggatataatcaatatttcaaagaaaatcaaataaatcaaaaaaatttaaccttagctgtttgttgagttgttcctaaatacggagacctttattttgctggatcttctaatttagagcaaattcgagataaaattgattttaataaaaaaacaaatagcgatattaacgatattagcgataaagaatttgaagaaaaaagaaaaaaaattgccccaatgcttttaaccgacattataaattaaataataaataatctttcttaaagatcaaaaaatctatgattcattcataggtaatttagtatattaatttatagtttgttcaatcgtttttattatagataataaaattattaataatgtgtattcttgaaactagtgataaaacagagttttttttgtagttttcaaacaaaaaaacctaaatattttttatttttcaaatattaattaaagccattttcaaatttgaaagtaatttgaaaattgctaaatttatccaaatttgtgtaaaaatttatttttagcttaatttctaaaaaaggataaaaacctgaaattataactaagttactatactaacttagttatttttaaacggtaatttccactttgaatttcgccttttgtttttctattttccctaatcggttaagtaatgtaaaattaaattagatttctatttgaaaaatccataaaaatttaaacccgagtttcccagtttgatgagataattttaaaaaagtgtccggtttcccgcgcttttttaagttttttgccaaaagttaattacctatttttttactgatttattaagatatcaaagtagaaatcatacctatttcaaatattgggatcactaggaacaccatcgcgatttttaaatatcatttgctgatctaaagtgttaaattcaaccctttgccttaatttttgcaacatcgttactaaaccaacttcagttaattgactgtttgcaaataacttgttatcactaatatgcttgttgattttaaaaattatagtttttaaaataactaatgagataaagcacaaaaatgtatgagctaggatatgatcatctattcttaaaaatacaggacgaatattcaataaaccttttagacttctaaaattagcttcaatatttcactgtttttggtatttttcaactatgtctaagacatttaaatttagtatatttgtttcatagacatagtaaccatcaaattgtttgtccttgtcaattttactttgatctaattcaaatttcatatttgaaatttccctaaaatatttaggttttttaccaaacaatttgtttacttcaataaaaccatctttattttgttttttaataaaactttggatttgctcttcgcgagccttgctgtcttttattgctctttttctactgtaagtaataattcttcttctaatattttcagtgtatcttttatttttataagatgaataaaattcttcttttttatacttaaaatctgcatttagatcaacataatcgctaggatctaataaataatttttaaatttttgactgcctatctttgcacgataagaaataatgaaattatattcttttgattcaagaaatcgaatatttgcagcagtggacatgccacggtcagcaattattgtcatatttttgatattatatttagattcaatatctaatacaaaagggattagggtactagaatcggctgtatttcctttaaaaactttaatatgaaaaggaatgccatttttatcgcatgctaaagcaatgacaatttgatcttctttgaatttagcatctttagaatagccaggaattcttaatccatttctttcaaatgtctcaaaatagactgttgatgaatcaaaataaaattcattgtccctttttccaagctcgcttataaccattttgttaagactatctaaaagttgattttgtgattcatagacaagatctaagagtctataaaagctatttttggaagtatttatttgatttgagtaatcatcctttttatcaaaagcattaataatgctaccaggatcagtaattcgctttgaaattaagtagttaaaaatttgtttcatatttttatgcctacttttaggaagtgattcaaaaatattgtgcttttctataagtttttcaattaattccccaccaataaaaaccgaaccttcgattatggcagaatttttaagagaatcaagtaaagtagtcttgattttatctttgtcatctaaatttgaaaataatttcaatttttctttgataatttgaatagcatttggattaattttttccaaagtttgcacatttcctatactaaatcaacgttttggagctttcccataaccttgtgttcagccaacatatttatatattttatcttttgaagatcctcaaacattaaacaaaatcaaattatgctttttcataatttataattataccataaaattactttaaaattgtaattaattgtaattaataaaaattaaggttttacgggtaaaaaacaccgatttacggcgatttctgcatattcatattcactaaaaagtgaattttcgccatcaaactgggaaactcaggattagatttctatttgaaaaatccataaaaatttaaaacacaaaattataaacactcccaatccaaccagttaataagcttaatcaatggttttcctatagttttaataatattttttaaaaaaatttgataaaaaaatagttgaatttagattattaatttgatttatatatgctataattttttaatttaatttaaacctaaaacaatttttcggggacaaaatgcatatagatttacatttaaataccaaaaatgattacaaaaattactcatattatcaaagctctaattactattcaaatggatgaaatagaaaacctagcagaagtgaagtttctgattttataaacgaactaatgaatgaggctaaaaaaagtgcaaaaatatttgataaagaaatgattttttcagtgttaagtgatcttgaatctaaaaatatagaagttggttttaatattaactcacaaaatacaagtgattttaatagagttttttttaattatttagaaaataatcaaggctcaagctttgacaaatatgtgcttgagtctgattgagagaatttatcttactgacttagaacatttgttgagaatgttttaacatacaagtattatttatcgaaaatatcaaatattatttctacagttattgggcttttgagtggaagttggtttatcgataatgctattaattttctttttggtgtagacactagcgatcctatctatgcttttggattatctaaaattttagataaatccgaaatcaaaacgccaatggcaaaaattaaggaagcattaagcaaaagtgggttagacgataaaattgttcaaaaattgtcgtctaagttttcttgggctaaatcaattaatcctgctaaaatcgggaatatgtttctgttgtttacatctattttcacttcagcagaatctagccaatatcaagatagaaatggtaatcttgattattttgtccaaaaagcaagaaaattaatagatgggagacgttctattggtaaattagcgttattattgaaaatgatcgattacaaggtatatgatgttccctgatatcgttttttagaaccaagtgtttgattcttaattagcggaaccagaaaactttcttcattagtagaagaagtctataaacgttctactgataaatatataaaagaactttatcaagaatatttaaatccttcatattattaatgtttaataaaaatggtgtttaatgaatatatctaagcattcaataattttaaataattatgttaaattttcaaactcttattttattaaaaaggggcaaaaagaacagcaaattcttacactttcaataatttcattcgtctttcttatcattttttttattgggtttggcctgctttgagaaaagaatatatgatgattaggtcctgcagtattttggcccttaccctttgtttgactttattttgttttaggtattttgcttagaaaaaaatttgttgagtattttgataataattccattcttaaatctataaaatttttaaaattatttttaataagccgcttgagttttgggcttttgtataaattaagagatgaaaattttgagaaatattataaaaaagccaaagaattagcaaaaattgacccctcaattgttttttatggctcattcgccgaaagtatgacttttttaaaatctcgtgaaattaacgatctagatttttgctcaagttctaatttacgttatgatttagggattaaaaaaacaacaattcttgataataaacaaatcattgacccttatatttataaaaaaaacgatgaatcaacgagaagtgagggacttagttttatttttgtaccaagaaaatatcaaacaaatgttgaaaatttaacaattacttcatcagtttaccaaattgcaaataaaattaatagattagtattacttccaagtatgatgaatttgagtgaaaattataaaattaaattcaaaaatacaatagatgatttaaaagaaatttccaaatttaatttgccttttacaaaagctaaactttgtcaatgttattttgatgcaattttgcaaaaaagccaatatatttgtgttttaaatcaagataaaatattaaataatattcaaaaaattgatttaaatttattcattgaaaatttcactgaaaatgtcgagttaaccttggaaaatccgttcacaaactatggaaaacccttcaaaatttccgttttagaattgataaaagaatttgagaatgacactaaaattaaaaatttacgtcttgcatttgataatgattttcataaattttttaacgatataattttgcctgatcctcattataaatctgatttgccattgctcgaatttagctcaaaacacgagtttaatattttcaaagaaaaactcggaataagcaatttatcattaaattgcttaagcccaaatttagtattttcatataaaaatgatcatagcattgatattaggcatatttttgcaatttttattgctaagaaatttaaggaattagaggaaaatgaaaaataattataaaaaaatttccttatattataaatcaacaactccctttacatacatcatttttcgctgatttattttagcaatagtggtgggattaatagcagcaggaatttatttttgggataattatgaccgtcttccggttccgccatatatttatgtttttattccactttgtattttggtagtgcctttgtttttacagacattaataaattctgtttatttttttgttagcccaaaaattcttggtaaattattagaaaaaaattggtttttatgattaagcacaaaattaatgtcaaaatctcgactaaataaggcagaaattttacgctacgttgactaaaaaaatttttcaataaaaatacttatttactataaaaaaagttatataattatttatgcaaataattatatacgaggtcattaatataaaaatgaaagcattagtttaccgtgccgatcacagcattgccctcgaaaatgttgtcaaaccagttatacaaaaaccaacagatgcaattgttagagttaccaacaactatttgtggtacagacttaggaatttttaaagggaaaaatcctgaagttgcctcaggtagaattttaagtcacgaaggtattcggagtgtttataattttgtgtttttcttaattaatttattcagtgatccaattgaatttattggataaattgattgtcttaattcatatggataatttaaaaaatgtctttgtgaaaatctaaattagtagaaaaaattcagacaattagttttttatctatgattttgattccactgtctttgttaatttttggcattctatttttaaaaaatctaaataaataacttatatcatataaaatttaagctcttatatgaaaagcaatagttacattttcaaaattaatttagatgcaaaattggctcatttttcttgttttttgccccgcagaaacaagttaattattttagattttaactttatattttttagattttttttctagaagtctagaaaagtctataaaaaggttgcttaaaatgcaaatgagtttttaccacaaactacaaataaaaattatttgcctgattttttttactaatttaaacttatatgtagtttttttcttttggatcttcttcatatttatctaaataattgttttttaaatcttcaattagttcaagtcggctaacttttttatcaaaaacgacatttttatccttaggaaaagccaggatttggaaggccactttatcaaaactagattcgggacttctaacaaaatttagtgttaaatccgtttgaaaaattgctgtcaaaaaaatattattattttctgtttttctaagaaccaatttttctcattccgccctttttgaaaaattagtagggggcgatataggctggagaacccctcctcaaaatggttcataaccaattcgctcccaagtttcgtaaataaaaatattattattttttagaaattcatcaagtttttcgctgtttagaaatttttcttcaaaatcagaaattaaatcattttggtcaagttttaatttaggatctaattttaaaattcggtcaataattgttgtcttaaattcgtcaatatttttaataattacatgtttttttggtaaaaaactgttagatcaaggattaattttatttgtaattaaatcaagaatttttggctttaaagttttaatattattaatttcttggctaaaatcgataatattaaacataaaagaggggtaagaagtactaatcttgttttttgataaattgtacttttttgcgagtttattataaatttttctagcttctccttcaattaatattttctttcttttatagtctatatttttatcattatggccagtgtaaattttttcttcaatgttcctaaaggtgattgttttatttttagggtagactataacattaaaaaaaggtgaatctttaaaaactacagcgggctcaattaaatctgcatctataatataatctggtgtaaatcttgtggctataatgtttgaaaaaccattttcttcaaaataatagtgggtaacacgagttggcattcaatagctgccacgctcgcctattataatattgtttttttctaagactttttcaagaagctctccttttagaaatttgtcttcaaattctgacttgagttcagaactattaacattggcaatattaggattattttttataatttcttcagttctatcaacaatatttttttgaaattgctctaaattttcaattgttattctactttgttcaccaaggaataaaaatttgtcccgttgtttttcgggttgattataaaacagatttaaggctgaaaaagtaccattttttgcattaaattcttcataatgcttcgctagtaaatttaaaaaataataagaattataattttctggattgttaattccctcatctttgttaaaaatttgcttaacaataaaaggaattaaatttctgcaggaagttaaaaaaaatgccggaattaaaagggttattcccaaaaatttactaaggattagtttatttttcattattaaccaaataagaaagtgctaatttatcttcaacagaattattaaaagttacagatttaaattttttgatataaagccgatagtagcctgattcttttgctctaaaatcaattaattcatcattgcttttaatacttgttgaccaagaaacatcaattcaattattgtttgaatcaagtttttgcaaatacaaatcataatctgaaacccaagtgtcattttgattttttttagtagcttctaagtttaaacgttcagaattaatatgtgtttttgaccatttgtcaaagtcatttttatatttgtccatcttagcttttttgaattttaatcttgatttttctatttttttaataaattcaagattaaaattacttatttctttagattcagtactcccgaaattagggtttaacaatagttttaattcgaattgattatcaaaatcatcaatttttggcgagttacttaactgtttggcaaaaggttctcttatatcgattttattactaaaatttgaagcatatcaatattttttagtattaaaatttataagaaaagagtgatatattaaaaaaattgatggtcaaaacatcaataataaaattatttttttaaatttcgctaatttcattttcatacccaattaaaattatttataaacattataacatgttttatgtttttaatttaattatattcattttattatcgctttaatttttttattgaaaacccgacttctacttttaaataaatatttatcattatacttttattaacaaattatgactaataatcatgagctttatttattaataatttgcaatattctaaaaaattttaaaattctcacaataaattattggccttttgccacataaaaaaaataaaattaaacgaaatctaaattagtatattaatttcagacacattcgaaaagaaggtgagtcaaaatgaaacaatagaaattcacagttgaagacaaatttaaatatatcaaaattgctgaaaccaaagggttaaaaattgcaattttgcattttgcagaaaaatttagagaaatttacaaaaacaaatctaaaagtaaaaatgcgcataaagaatggattttacatatatatggtaataatttgataagaaattggaaaaaagttttataataatggtatgaaaagtctaataattgctcgtgggaaaaacaaatctcaatgcagaccaaaaaaggaatatacaattaacgatctctctgaaaatgatcgtggaatttatcaagaaataatggagaatgttcttagaagatccggaattgaccccgcaattgttcttgaagagctcaaaaaacgaaaacaagaactagaacaacaacaaaagcaagaacaagaaaaagataaaatggaaaattaagttagtatataagctagttttctgaatttttctactaatttttaggaatttctacttaatactttatataaaatagcgtgtttttaccttcgtttaatagaaaaattcacaatttaaaaatattcaaaaacttaatttcttacatgacctttaattaaataactgattctattaataaaatcatcataatcatttattattactgaattttgaatttgagtttctattggttttagtatatttgaaaattcaaaagcattgaaaggattgtcaaggtgaaaattagcgaccgttttataatcttcaaaattttcaatttcatttatattattgtgttcagaattattttctaaatttaagcaaacaaaattgataattacaattaaaactttattaggtatatgtctaaaatctgattgattttcagttgaaagttttgcatatttaagaaagttcttataatttaatttaattttccccattttttattaattctatttttagaaaaataaggaatctgttcaaaaataattaagatctgaaaatataatttatcattttgactacgaatattggcagtttctccaagcatattttcaaaataatttattgaattttgtaaataattttgcacaacaaacttaagacctataccagcaattatttcgtttttatattcaattccgatatctacttttttatcataataccgaccgatcattttagcttctttttgaaattgatttccgctatcaacacctaatgaatatattttaaaatcttgccctaagttttgcgacattgaactagcaacaaaactatgaattatctttattttttcagttgatcttgacgaacctttatgaagataagttataaaactttctttaattttttcatttacgtccctaacataaagtctaaatattttttaacatcttttgttgaaaaagtataataaccaccatttttgtactttcctaataattctacaaagtcaagaaaaactttactttgtaatctttcagcaattgatttatagtcaattttctcgcttataatgtaaaaaccactataaatacaggtgtttttttggattaaacttatttttaaaggtctgttttccttgactaatgaatttaaaaccagtctttctttatcagtgtctgaaatagcttgtcttcgaccaaaactataccaaaaatttttatttgaatgatcaaagctacgtttttgcagtttttccttaaaaaaactaaggtgttcaaaaatttctaactgctgttttaattcagaatctgaaataatttggaaatttttagtattatacggaaaaatgatttttgcccattttccatttgatgcttttaaaacgggcaaaatatatttagaattaaatttaaaatcgccaataaaaactgaatcagccaaggttgccaaaccatttttgacactaatatcactttttttcttgttgtaaataatttcctttagaaaagatagcttttctggagttgaaaaataaaaattcttatctaaataaaattgttcatattctaatttagaaacaagaaaaattgaatttgttttattatcaaaattaaaataatcgaccacttgttttctagctgatttatcaattgtgaaaatcgttgtataagttgttgctttaaaaaattggtgatgtttatgatcaacaactgattttatgattttatttttgtataaaaattcccgaaaaattgagcctgctttggatgtaaaaaatgaagatggactaatataagataaaattccatttttacttaacattttaataccaatttcataaaaagcaaggtaaatatctgtcataccaattgttggaaaattaaaatttttcaacaatttattattatttaaattatgaatgcgaatataaggtggatttccgacaacaaaatccatttttccgttaaaatgttcaatttcaagggtatttttagctttaaaatctcagtttactccttcaattttataattttgaacaactaaatttgcacggaaaatggcattttttatatgtttttcttcaatatcaatgccatgaatataagtttctaattgatgtttaagcgattttaaattcgaattttctctaaaaaaagctttgcaataacgttcaataattttaactaaaaattgaccattaccacaactgttatcaataatatgttttttaagtatgttttctttgtaaccagcttgatctaaaataaggtcaaccaataaatctggtgtaaaaacttgcccatttaatttttgactaacattctcatgcataaataaacttttatttcttattttattttaaattacgaagttaatataaaattataccaaaaattagcaaaagttatgcattcaaaatcattgataaaaactaattgtctgaatttttttctactaatttaaagttaaaattagaacattcttaaaactttacaaaaattaaattttaaatacaaaaaatttaattaggcgttctggagtaagccgcactataaaaatagcgaacaaaattataccagtatagttgatgattaagcgagaatcatcaagtagtgtaaaagaataacttaatattcaaaacgagtatcaaaacgtaataaaatttataaaagctgaaaataaataaataattaagaaacgaacttgccgttttttaataataggatttaaatcagcgctttttgtattaaatgagaagacatgtaaaaatatatctaaataataggaaggcaaatatacttttgtagttaattccaaaccttcaatcataacaaaaatattttcaatgattttatcagggttatatctatcttttttgcgtacgttgattcaaatataaacgtttttttcctttataagattataatttttttcaaaatcaaaattagctaagaaatcaaattgcttatttatatctaatttacctaatttttttttacatttctttattaggtaaaaattaaaaattttttggaaaaaactacacaaatatgaataaggcaacaacaggagcgagtaaaaaattgcttcgataaaatgtcgaaaaaagtaattatcaaaaatttttgcattaaaatgaattaaaaaatcaaatttaagcgtaaaaattagtattaaaataattaaaaaaaatggtagtggataacttattaaaaacagtgtgaatagcaaaacaaagtgtttgattgtttttttatcaggattaaatttgaatacaagaaaggagaacaacctaaaatacaaaatattacctaaaataggaacttttgaaaattctctaggaattttcaaattaataaatttttcaacagttaatcagaaatacatttttacaaaacaaatttccttgaattaaattaataaactggttaaacaagtctaagaatcaaacattttgtctttaataatactatcaaaaaaatcaaaaatttattcttcaaatagtcaaaaagttattcataatttaggataataagccacccagggtatcgtgatataaccaaaaaatatagtagaaaaactagagagtaataattgtattgtttcgttattagtatcatttaaattgccatctacttcagatatatgttccattataaaataagatattattcaaaacggatatcaagttagtataagatgtataaaaacaaaagcaaaataaatgtataaaaagattttccagttttttttaggaatatttgaatttgtaaattcagtagtgttaaacaaaaaaacttccaaaattatatgtgcaaaatattttggcaaatttcaattaattactcaccatcaatattggatatagataaaaatattttcaattattttttctggattataccaatgttttttttcaataccaatataaaattttcgttgacatagaaattcataatatttagtataattaaaattgtttaaaaatgggaatttattatttgcgtccaacttgccaagattttttttaacttgttttaccaagtataaatgaaaaattttttgaagaaaacctgaaaaataagaataaggcagaattaaaaacgagtagccaattacttcgatcaaatgccgaataaaataattattaaaaaattttaaatctaaattccttagaaaatcagcattatcggtaattaacaatattattataattaaaaaaagaggagtcggataacttattaaagaaagtactacaaataaaaagtaattttttattgtttttttatcaggattaaatttaaaaactaaaaatgaaaatagtttaaaatacaaagtattacttaaaataggaatttttaaaaattttttcggtatttgaaggtttataaatttttcaactgttaatcaaaaattcattttaaggtataaactccataattaaggaaacaaaagactgcaaaacatcaagccaaatcaaggcaattctaacttgcggcgcaactaaacttgcagtgattaatgtcgcttttgttgtagattgcgcactttttattttttttattgctgatcgtgcatttaatattgttttcaacgatagccccatagacccgattttaaggcctgttacatacaactttgttttaatagcggatcaatttttatcatatacaagactattataagcctgtttatattcaacagaaagtcaggttaagacacttccagctgctgtgctagcgccggcttggggaaacataaaagcaaagccataggcaaccgctaggccaaaatttatagcagcaaatgaggcgctagtaacatgttctttccataatttatttgcaaaatcttctatcgtcatagaattgggcgaattatttgaaaatgtttgcggttttagatttgttattttattagcgttaggttgggaattagaaggttgataatcaaatatttctttaattttattggaaggcacccctttcttttccaacatttctttggcaagtttttttgcatctaaatctggattttgcgaaattttgtcgataaactgttgaaaatccttctcaaattttgagaaatccttaatatagggcttagaatttgggtcagttgatgagaaggatttaacattaatttgccttagctcggtaattacctttgaagattctgattttagtgtgtccttaaaataggaaggaaatatactttggtcatcattaattgctttttgtgatttgcttaaaaatacaaaaggcaaagaaactgctactgatccgatagttacaccaaataaaattgatagttttgcaaatttggtcatttttttttttttttttttttttttttttttttttttttgcctttttaagcactattataagtataaataatataataaattctgttaagttagtatatcaatttaggttttttaattaataggaaaaattcagataattagtttttatctattattttaattataccacttttgataattttttctagcatattcattttaaaaaatctaaagaaataatttgcctaatataaaaacttgaatttttatatgatggacaactctttcaagttttgaatagttatacaaatcaataaatgaacttattttttgataagtaataggtacattttcaaaatttttacttcaatattgattaatttttgctcccaaaaggcaaaaaaattcaatagaaataattaggattagccctatctttctaagaaaattttccatttttcctgataaattcggctatcattttttagaaacagtcttaattttctatttcttttttgggttaacgggatttatttttcatagacttatcaaacttttttgccaatttattattaaattgtttcattttgacacctttttttaatgtgtctgaaattagtatactaatttagtttttattttgaaaaactttcaaattttactcagttgcttgaaaagtatcgttattttgctcaatatgtcttgaattaaaaacaattttttctgaaccatcatcttttcagaaaataaatgtgtaaaatttgcctttttctagtttctgatcttgctcatctcatctaaaaactaagggaaactcaatattttcaccttcaattgcggttgtacgagcgaccttaacttttaaaggatcaactagagtgttgtcagttaatgattttacctcagtagcataagcgcttcattttcctgtaacaccttttaccggtgagtgatgcaattgaaaacggaaaacaccttgactatctagtttattttcatttcttgcagctggaaataataaagttcgaattttgacattatctttttttggaatattaaatggagcagaatgaaagtcgattgtttggttagtttttttagtttttgttgcctcttgattgcccatttttatggctttatttttatcttcttgactagtttgggcatcttttttggtagtttcaggagctgtttgacttttatcgtggcatgataaaacaataaaaataggcagtacagaagctattggaacaagccttaatttaacaattttttttatatttttgaacatttttctccttttttgctcagttttttattttttttgctttgaaaaacaaagaatttaaataaaccaataagattttatagcccctaaatttaaaattactaaattataccattaattttgaatttattaatgcttaactctaaaaaattttataattttggattttaagaatttatatggtatatttttattataaaatcaaaggaaaaaatagcaataattactagtaaattagtgaaaaaaaattgataaaaatggtaaaatcaaaattatagataaaaagctagctgtctaaattttttcaactaaattagccactttttagctatttttattggaaaataactaaaaactggattaaaaaagagtatttttataataattccttttaaaattgaaccaaggagtaaaaatgaaaataataaatgattattttaaatttgaagactataaaaacaaggcaaaagcggaatttcaccctaaattagatgaaattatcaagaaaaaacattcaaagtctcttgaaaaagttgctggattacaaaatgaggcaaaaaaacttaatattacctcgtcaatttcattctttttaactatgattgttattcttgttgctaccaatacccaactaggatatactagcatcatttttgccattattcccggaataattgcaattgtttctactttttacttaggattcaaaaaaaaggaaattagaaaaatcaccgatgaaatttcaaaagacgtcctagttaattttagaccagaagttgcttataaagctgccttttcaattttagataaaggaatggattatttaggttttaatgaccaacctagcaacaaaattcaaatttcaaaaaacgaaattactaaccttactcccgtagaaataattggctcatcaagggcttgaattagtcaagttagacctctgaaggaattattaattgatgaaaaattccatgttagctttacaaatgtccactgacaatgaaaagaaacaagaaaaaatgaaactgtgacaagagaaagttttactggaattttaaaaattgatacttcaattttaggtgaaaaggcatttgattttaaacttttaaaaccaggcagctgattttttcaaaaaaacaaagtcaaacttgaaaacgaggaatttaaccaggtttttagtccagaatcaaatgatagattgaaaatcagaaaaatgtatacaccccttgcaatggaactttcgctaaaaagatattttgaccgtgatggcgttaaagttttggatgttagcattgaatcttttcaaaatgcgatctattttacctacaaatgcgactgaaattttatgtatcttgattttccaacatcaataaaaagccctgatgactttattaatcatattttcaacgattttttgattgacacttacagtttgtattatcttttgtgtcttatttacgttactttgtatttggattagttaaaaacataatattttcaaaaaaaatatggtataatttttaatttaattaatatttaaaggaaaaaaatgtcaaatttatacaaccctaaaaattctgcaaatatcgaaggatttgaacctcgaattgataatgactccaaaaaaccggttgtttcaacagcggctaaagttgcattttgaactttggggacattgtttttatttattgctccaatttattacatttcacaaaaaaataattttatgcgacagcagaatttaatcaatgaatcagctggtacaatcgaagttcaacttgagcaacgtagcgcaactttattaaaattagctgaccaagttcgttcatatcgtgaatatgaaaaatcaattttaagcgacattacaagattaagaagtttaaagtcaaacatagaaaatgctcaagaaattgaagatttaaacaattcattatttggcagactaattgcagtaagtgaaaattacccagaattgcaagcatcaaaaatttatcaagaattaatccaacaaacagcctatttagaaagagaattggcggctgcaagacgactttataatagcaatgttaattcttttaatacccaaatttttatctttccttcttcaattgttgcatcttcgatgaatttgacaacctacccaatgtttagcacaagcaaccaaaatcgccaagatgtatcattcaaagatttttaatttcttatattaaaaacagacataatttctcaataaatttgcaatttaaacaataaaaattttaggaatcaaggactaaaatcccacaacaataattaattttagatacttattgttatatttttatactaaatacacaaaaaataatcctaaaacagtataaaatttaaaaaacacacctttagacaaataatatcgcttttaaatccaagaaatatttgcttaaattaattcttcaggtttcgtgagatttatttgccttatttttatattaatttaagttagattagctcgttaattttctattagtcaaactaataataaaatgtattttaaaaatctaaaaaaactcttactttataagaaaaaaacaaaaaaaccgtgaaattaaattagtagaaaaaattcagacaattagttttttatctatgattttaattataccacttttattaattttttctactaatttaaatgtttggccttgctttgttagagaagtgtgatttctaattttttaaaactattaatgtgacttatgcattttttggtgtgaaattgtctaatgattctcttttgtcgatgtaggcaaaaaataaaaacattaccattgaaaatacatcaaacaatggtatgaaaaagccaataattgctgtaattttaattattgaaagttttagtgattttgatgaatttggttctatattcataaaaattttgtcagggaaacttacttttacgatataactaatcgttaaaactcggcttacaatagtaacaaaaattcaaataaacatagttgctataagttcagaaccaacaataaatgagtcgcgatttgaaaatcatgtgataatgaaagggataacaaataagaaaaataaactagtgcctaatataaatttaagaagacgcactactagtgataaaaaagttagatttttaacattggccactggttttattgttttactaattttcataatataataaattatactttattcttgtttaaaagttagaaaattatttttaaatatttaaattcctgttgttctgtaatttagactttaaaaatattgtaaattttgaggtgcaaatgtttgttgctccaaataaaatttgaataaaaattcaaaaaattgaactttttaaattttttgatataaaagttcatatttttactagattttcctttattttataagtaatgttataattaattatgtaattcataaaatatttagttattaggattttttatgacatgagcaaaaaaatatagatagtaatttgcttaaagatctaaaagaaactctaaatatagaatttgttgatttaaaaatattagataaaaatattaatttaattagtaagtcaactagtggtaacaaaaatcttgaaattactgaatttaaaattccaagcatttcgttatgattctaatgaaaataatcttcctgagctggttataacttatgtcaaaaaatagtaaaagaaatttttgaacttttttctcccttggaacctggttttgaattcaaagctcaattttagttgctatcggtgggtatttaatttatgtttatgattatcaaaatcaacagcagctgtcaaaaataagtgaatatcgattttgaaatgataaaaagaatgtcttaacatttgaaggtgaatatcctcgtttttttatagataacatccataaattaactgatgaagaattaaaaacaaaaacaggctctaaaaaatcattgaatatccatgattttagagatgagtatgtatttattagaaaaaatcagttttcgtttaaaaaggaaaaacaggaaagtgaaaataataagcaattatataatactcatttaattaaaaatacgcaagatcttgttgacttaattatacctaataagcaaaaattatcctcactaactaatagacctggtacgggatttcctgatgaaaaagagattaatgaactaagtgaaacaattgatttatcaaataaagatgcaatcattttgaataattatgttagtcaactttttggttcttgaggtgatcgaagagcaaaagggctaaatcttattgattttagttttaatgaaaatacaaaaacaatagaattaaaatggaaattccaagactaccgtagcaaatctacaattgttcaagcaatagggtacgatgattggttcaaaagtcccgagtttcccagtttgatgagataattttaaaaaagtgtccggtttcccgcgcttttttaagttttttgccaaaagttaattacctatttttttactgatttattaagatatcaaagtagaaatcatacctatttcaaatattgggatcgctaggaacaccatcgcgatttttaaatatcatttgttgatctaaagtgttaaattcaaccctttgtcttaatttttgcaacatcgttactaaaccaacttcagttaattgactgtttgcaaataacttgttatcactaatatgtttgttgattttaaaaattatagtttttaaaataactaatgagataaagcacaaaaatgtatgagctaggatatgctcatctattcttaaaaatacaggacgaatattcaataaaccttttagacttctaaaattagcttcaatatttcactgtttttggtatttttcaactatgtctaagacatttaaatttagtatatttgtttcatagacatagtaaccatcaaattgtttgtccttgtcaattttactttgatctaattcaaatttcatgtttgaaatttccctaaaatatttaggttttttaccaaacaatttgtttacttcaataaaaccatctttattttgttttttaataaaactttggatttgctcttcgcgagccttgctgtcttttattgctctttttttactgtaagtaataattcttcttctaatattttcagtgtatcttttatttttataagatgaataaaattcttcttttttatacttaaaatctgtatttagatcaacataatcgctaggatctaataaataatttttaaatttttgactgcctatctttgcacgataagaaataatgaaattatattcttttgattcaagaaatcgaatatttgcagcagtggacatgccacggtcagcaattattgtcatatttttgatattatatttagattcaatatctaatacaaaagggattagggtactagaatcggctgtatttcctttaaaaactttaatatgaaaaggaatgccatttttatcacatgctaaagcaatgacaatttgatcttctttgaatttagcatctttagaatagccaggaattcttaatccatttctttcaaatgtctcaaaatagactgttgatgaatcaaaataaaattcattgtccctttttccaagctcgcttataaccattttgttaagactatctaaaagttgattttgtgattcatagacaagatctaagagtctataaaagctatttttggaagtatttatttgatttgagtaatcatcctttttatcaaaagcattaataatgctaccaggatcagtaattcgctttgaaattaagtagttaaaaatttgtttcatatttttatgcctacttttaggaagtgattcaaaaatattgtgcttttcaataagtttttcaattaattccccaccaataaaaaccgaaccttcgattatggcagaatttttaagagaatcaagtaaagtagtcttgattttatctttgtcatctaaatttgaaaataatttcaatttttctttgataatttgaatagcatttggattaattttttccaaagtttgcacatttcctatactaaatcaacgttttggagctttcccataaccttgtgttcagccaacatatttatatattttatcttttgaagatcctcaaacattaaacaaaatcaaattatgctttttcataatttataattataccataaaattactttaaaattgtaattaattgtaattaataaaaattaaggttttacgggcaaaaaacaccgatttacggggatttctgcatattcatattcactaaaaagtgaattttcgccatcaaactgggaaactcaggaaaagttatattcttctaattgataaaaataaaattaatagtcttgatagtataaagtttagatctaccttttcttaaaattttagatagtttttttaaatcttcatctttttaacttggagattttgatcaaaaagtctctaatatttgcaactttgcttcattagatttaactcttatttttgcttagttggcagatattattgttttgcgctttaatcctggtagtcttaatttattccagaaatttataattataactagtggttgagttaacaagatacctgtttgagtcaattaaaatatctaaattgtgttcttgctattccattccgtgaaactttatcttaataaaaacaaccgccataatatgataaatattgacggttatttaatgattttgcaaaaataataattatttatatattttagcaagttgttctatactatttttgtttgctaaaaaactattaggaaaaaccaaaaaaaggtttctgcaatttatattaagtttcttggttctaaattcagtttgttattctttattattagtgaaattttatcattttaaatcaaatagtagagaataaaaactaaaaaatataaaaattagtgcattaatttataacaacgtcattaaatttttgtcttattttacattttttttattttttgtatagcaaactaaaattaagctgttcctatttgattatgcaatgagttaaattcctgtaatgttttgatttttatgtactttagctttttaatatcagtatttccaatatctattttttcaaatttttgaagatcattaactataaaattatctggttcaaccgcaaaattaggaaacaaatctttataattaaaggtataaattttaattatatctttctctatctgccaatataaaatctgatcgtcaaaaataatttttggattttgttttttaagtatgaatttattaaattcttcagagttgttatcgttgttaatgaacaaatttgaagggtgaaaagcctcgccccaatcccagctttttaatagcgaattattactaatgaatttttttgtttgatctaatgtagaaaaaatttggttttcttcagtgctctgctttgatagatctaaaccctgcatagcatataaacgagtaagttgaaaagggtttttcttaaaaatttcttgcttttttacaagaaattttttaaattcatttgattctttatggcgaataattttattgtaaagtacaagatcttcaatattactaatatgaatatctagactatgatcaaaaacatgtttgtttgacttatctataattttataaaaaatatcgaaatttgtagttgttgaatttgaaaacagagaagctctagcaaaattgtagttaattacttttggcggaccggtctctctgtacttttctcctgtacgaaaaaaattatcaaattttgagtcaaaagaaataatacttgtttttccattattttgtttgttttggaaaatatgattagggtttaatgatgatatttttgattttgaattaaacgatgaatcatcagcaatatcatgaggacgtatataaataataattgattttttcttaaaaaagtcaggtgttgacaaaattcttttacttagtttttcaatttttaatttagaaaaaaaagatacaaaatcatttttattatctaagacaacgaaattgtctacaattttcttgtcttttaattgcccttgatcccaaataagattaaattccattgtgtctttgtttttggcgctctcagaacgaaagaaacttgataattttcttaaagcgttattgttaaatgaattatcaaataaattgttttcaaatagggggtatttttgaattaataaatccactttttggggctgttttgtcaaaatgttatatcaatatgggttatttagtcataaaagtttattaagatcagttatttttttagagtctgagatactaaaaaatttattattatcatccttaattttaaattgggtttcattttttaaattatttttatagttattataaatattaagaatcaagccaagagaaaccgcggtagcggcggctaagttggttaatataaatcctattagaaaaaattttttatatttttttaaatccatgctagccttgtatttttttatatatattattaaattcttcgagtgaatttactgtttttaactccacatctttaatatttatatcaccaaaatcaattttttcaaacattagtaaatctttattatttaatttttcaatattttttaaggtttttggaaaaattgatttgtagtttaaagaatagagtgtaattttgcctgagtttttatcaatttctgaataaaaaacttcatcaagaaaaatttcatttactttttgagatttgagaatgaatttattaaatctttcaggtttatcaatatttttgctgggaacaaataaattagagaggtgaaatgcttcttctcattcaaggtttttagataaatttttattataaataaattgttttacatcgtcaaaatctaaaaaaatttctgttttgggttcatcttttgaatattgttcatttttggacccatataatgtggttatcttcaaattattacgcgctaaaattttctcttttttggtcattagatctaaaaaactctcaaattctgacgatgttttatctaagaagttatacaaatataaatcctgaattttatttaattttatagttgataaatcgtttgttttttgaaaattgttttttgaataaaccttaaaataaacatcaaatttatcatctaattttgtaattttgttactatttttacttacatctttataattaaaaagttgttctggtagtgaaataataaaattatgatttttataagtcataaatttaataggggacaattagtgggtaaatatttttcatttataagtaatgggttagctaatgttttctcggcaatatatataaataataaatttttagtaaaaaaatttttatcatattcattttttaaaaaggttggcttgtcaacatattccttaaaaaattcctcatactggttaaaatcattgataataaaaaaatttttagtaaatattttttggtaatcaccaaaatttggatttacttttaatttttggaaattttcgccttcagtagtagctttgtcatactctttggagaaaaaagtagacaatttattgaattctttgtcgttgtaagttttaaaattgtcactttcaaaataaagatattttttgattatttcttgaattttttcatggtcgttcaaaaaaatcggcattcagtcactatttttaagccaaatagtctttgttttatccatttgtattaaatcattataggaaaaaatgttagattttaaagctttactatcctttgcgcttatagtgaacaaatcattattggtagggtttgaagtttttgcttcaaaattgtaatttttattttgaagcgcaaaaattatagctgggaaaatccatggcaaaataattgaaggtgctaaaaataaatattttttgttattgaatgacatgtgaaaccgccaaatcatcatctatggaattttcaaacaaagaggatttatgttttttaacaactaaccgataaattcctgttttttcagctctataccttattaattctacatttgatcttaatgagcttccagagttcaatttaatgttttttcaaattcctccttcttttctttgcaaaattaaatcataatcactaaataatgtatctttttgtttttcaaaaagtgtttttctatttagccactcatcagggtattttgagttatactctttttcatatttttcttttaaaaattggttatatttattttcagtgattttatcaataaaataagaggcaccgaatgttaataatttataaacccaagaatcaattttactttcatatttttttaatggtttagttaatccagcattaaaggctcaagcaagcgaagcttttaactttttacctttttcaatttctatatctgggcttagataaacatactgactatcattatcatatgaaacactaaatgtttttaaatttgaaatagctttttttatgtttttaaaactaatttggccggctccaatagctgaatccaatccatttgacttagtttctctttcattatcgtagttttctaaatatgatttttttgctgggtctgaaaaataatcatcaattgaagaaacaacaccttctttttcattggattgttttgttgactcaatatataacttaattctatccaaatcaaaactactgtcattcgccgaagaagaaagcaaactcattattgcgggaataaaatttttatcattaaacattcacgaatataatgaatcaattgttgatattattccagttacaatcggtgcagaaaaactagtcccagaaacagggaatttttgacctattattccagttatattttctccgggagctgaaattaatggttttggtaattgatttagtctataaggtagtaatctattgctaaaattactagcaaaaaaattgtctttagtgccaaaagttgaaccaaccacaattgaatttagagcatttgcatacccagatatgtaaccatatttttttgcagaattattattttttcatttatcatcatattcatttccggctgcaaaaatgtttataacaccatactttcttgataaaaaatctaaataaaagatgtgatcgatgtattgaacaactgaattttccataattgaatcaaggttataaatattctcaaagctagcttcaatatctcttttacttatagaattaaatccataactatgatttattattttaattctatactcaattataagtctttcaaaaactgtcattcaaattggagagtcaaaatttgccttggctaaatttactataaacatatctgagccacgagaaaacccgcttcttccacctattattcctgatactaatgttgcatgatcattttgatcatcttttagcttttcttgtggcgctctacctatgttaaaatagtgtatttcattatattcaagctcggctttttttgcatcgttttcatcaaaggtgccactcatatccgcttcaactacaccaaccctttcacgtggggcgccattaacgtgatcatactctactatttctttttgttcattaaaaaattttggttgcacgggcctaagaagtcttcatagtttattatgattatcatttagtatagtatggaatcacttattagaaaaccgttggtttgtaattttaaataattcaaatggaaatggtttttcagaagttgttttcggtaaattattaattattaatgcaataaaatctaattcttccagaagtttaagggcgacatcctcgtctttaacatcgatatttattcatattattggcgataatttgctaatatatttactattaattttaatattattttgcaaaaataacttagttatttgatcgaaatatttgttattattagttgtataatgattaatgtcatcaatcatcgaattattggcagagtcactaaaatctaataataatttaatatttatggtttccgtgtctaatttttgttctttaaggttgtaattattcttgttctctttgtgtgaataactttcgaatttttttttagaattacggctgaaaatttttttgtgttttttctgttgtaaagaagaaaaagaatagcctggttgagaataaatatctatatttttactaaaaattgggttatttatataattttttttattattaataggtgtatcagaccaataaaacacagtaataattactattgcggataggtataaaatccatttaattaatcgtttgtatatttttttattcataattttatcgctttctaatttgcattttcttagagactaaacaatgactaaaataaaggaatattcatatctaataagatacaataacactaaactatgaatagcaaataaattatctataatataaattataacaatttttctagcttctaactcaaatggggataattttttttgctcttttttcatattttagtcctttatgataaattttatcaaaacagatttaccttaaaccacaaaatatttaatattctccatttttagtaagatctaaattgtggctaactatcaaaatagttttttttcaaaaagaattttaacattttcaagatcaagatttccagtaggttcgtccagcaaaataaagtcagatttaggtgctaatgatcgcaagatcgcgattagttattttagccgcctgataaatcactcattttattagctaaattttcttttctttattataatattttgaaattaaactaataagtttcggcaaattcttttttggatctatatttaaatagatattagttatataataaagccgattaaattgaatttggtttggtaaattagggactatttttaaaattgaatttattttttcaagttgagatttatcatctgtcatttttgcaaaagcgaaaatattattcgcagtttcgaaatcatattcattttgaaaattgttaatttagacataatataacctagaaaatttataaactatttttaagaagttcagtaacaggttttttgtaatatcttaatgatatgaaaaaatagataagaaaaataagtaggctagttgcgaatcaaattaaaatgaaattaataaaaatttgtgtataagttggactgataaaatcagcggttgttatcaaattataaaaatatggcatgctaggcaaacttattattagacctgatattaaaattaaggaagaaattacaaaaatatttaatatgtgtaagaaaaagatttttctagttttttctcctagtgatttaagaattccaattgattttatctttgattgtgttaaattttttgcataaagaactgaaaaaactaccaataaaactataagaattatttgaataacaagcaaaactgcttttattaaaaaagtggagcttaaaactaaaacttttattgattcaagatcttttgaatataaaaaatttgaaaaatcctttttaaatgaggctaaattttcattgatattgtcagattttaagaatatttttgcagcttgtggtcttatttggtttctatattcatcaccgtcattgtgcattatgatttggtacttaaattcacgtctttcttcttcgggggcgccaacttcagatttttgttcctgcaaatgatggttttcctttagatcaaaagttccgactattttaaaaggaatatcatgtccagttttgtttgataatcgaactttagaccctatttttagcatctcgtatttgtcgattttaaaatcattgtttttgttcaattcagtaattctattgtttaaattatcgataatattatttattttatcaatagtgttaactgaaacaacaatttcatctttatttttaggaagctcaccatcactaatttttaaattttctacctttaaatcttttaaaaaatgttttttttccacttccaatacttgaaaattttttgcatttaaaggagcgattgttatatcgttgaaaagcgaatcgccgactgtgtttttaacaaagaaagcttcattaattttttttgttaaattataatgtaaaaaagagggtattctacctaagacattagttgaatagtttattccgacaatagcaacttcaaaaattgttggaattttatcaacattcgaattacgtatagctttaattttaatttttttgccaataggatcggtaatttttaattttgtaacaactgaatttgaaataattatctcattttcattttgtataaaattaccttgaaggtttttgtcatcaaatttaaacctacttttaaaaaaatcagattggtcgattaattcaatagtatttttttcagaaattaattcttttcccttattattataagtaaaagcaaaattttgagttgaataaacaggaataattttattaacaatgtcttttttagtattgaatttctcgatttctccatcaaaaaatggtgatattcccctttttttaacctcaaaagaatccaaattgtattgatgaattcgttgcgagtcaataccctttgcatgcgtatcaagtgtagcaaataaatttaggcttaaaatgctaattagaaatgtgataactagtaaagttgtaataattattttatttttaaaatctagcttcaaaaataaaataattgatctaaatttatcacttatttttaaaggttttttttcaaatctaaaatcataatcagttttatttaaagattcgcctttatttatttcttcgattttatcaatttctaatacagactcattttttaggtaaattattctatcgccgtattttttagcaagatctaaattgtggctaactatcaaaatagttttatttttctttaatatttgtattttttcaaaaagaattttagcattttccacatcaagatttccagtaggttcatctaacaaaataaagtcagattcacgtgctaatgatcgcaaaattgcgattcgctgtttttgaccacctgataaatcactcactttatttgctaaattttcctttgaaatattaacaaaacttgcattttcttcaatattcttttcatcaatattaaaatttattgcatttgtcccaattttaatattttctatgccagtagcagattcaattaggttaaaatcttgaaaaacaacgtcaattaaagggtttttaacaactttgttatctttataaaaaagaatttcacctccatctttttgactaaaattagcaattaggttaataagagtagttttcccaattccagaaggtccaacgacaaagaccaactcattagatggaatatctaggctaaaatttgtaaaaatagctctttgattaaaatttttagtcaaatttttaatttttaccatttttaagtagccaatctatttgataagtcatataaatagttttaatattcaaaaagtgtgttttacctatttttttatcaattttagataaaatatctttttttaacaatgaaataaatttttctaatttagtagaatctatttggtgctctaattttgatttaattgtactttgaaattcaatataccaaaaaagatgttttaaaaattcagcgttatttatatttttttcattaagattttggtttataaattcaacaatttccttgttgtcgtctaattcatttttaaaaataaacttaataaataagttaataaattttaaaaaaaatggagcatttttttctagttttacatttataatattgtcaaaaatttgcttggaaacattaatttttgttggcttgtctgtattataaaaactatttaatagcgcaattgttttaaacaaataaaaaaaatcaattggtttttttacaaatttactataatcaattattgtatttaaaaaatctttttgactcttaaaaaaatcgggatgattcttaattgaaaaaaatacataattatataagtcctcaaaaaaatcaggattattttctggtttttcagttgtttgcttaaataaggtttctattgtttgatttattttttgcacttgattatcttttttctcactcaagtctaaaatctgttttacaaaaatagtttttgtgatgtcaggttcgtgagcaaataaaccattttcaatgccataatctacaatttcttcactttttttaagtaattcgggctctatttttttattatttccaaaataatagtaaagaagacctgaaccataaaaacttggatcgcttgataagctaaaatttattaaccaatttttagtaaagtcatttatttttgacaaatactctgatgagtagttataaaaattcttgctaaaatagtaaaaactaaccattggtgtgataaccaaattgctttggttttcttttctatctttattttcaataatttgtctaaaatggttatctcattttttaattaaaacatttattgatttttgtttttcatttataatgtctacaaaataatccttatctaaattattaattattgttaaaatagcgatatattttctaaaaagtagaaaagattttttttctgaagtttcatgaggttcattatcacttattagtacctcttcactttcaaaatttgctttcttaaattcatttttaattcaatctttaatatcgaaatatttttgaaaatcatgcccatttaatttaaaatataaaatatttcatgctagagcttgaaaatcctcatcattaatattaataaattcccttttgtttttgtcataatattttgaaataaaattaacgagtttaggaacgttattaattgggtcaatattaaaataaatattgcttatttggtatacatcgctcaaactaaattgtattcttcgtgataaattaggcgtagtttttaatattgatttaagtttctcaaattgcttaatattatttgtaatttttaaaattgctaaaaattcatttgcatattcgtaattatactctccctgaaaattattttttagagcatagtcactcttttgtgtacctttttttaattcgtcttctaaaataaaactgtttattttttcttgatcggaattagaaaaaatagatgcagattttgaattactagttaatgttttaggctcgaatctatttatttcaaccgcaataaagctattaaaaccataataaattaatggcacacttatagcaattgatcccaaactagcgccaataatagaaaaaataactcatttttttgtaaaaattttaggtatcatacctattcttctaaactttcggacaatcatgaaactctatgataagaagaatcagacaatatacttgcagttttatatttatatttggcatgtgcagacgctgaactaccaaaggtcgttactttgtattttcaaccatgaaaatcataatctattcctgcatatctatgattataatcggtaattgagtcaaccagatatccatttgagtcaatggaaacacctgtatttgcacttgccttagccgaaaatttaccatcgtattttatttctcctcctactgaaaacgaaggacttcccattccagaaattcaagatgtcacctttaattctaatttgtccgggttagaataatatgaatttcttggtctaaattttgttcttgcttttccagttcatgaaattttgtcttgataaaatcaaccgccataatatgataaatgttggtggcctattaatgatattccgaaataatagtctttatcatatctttgagcaagttgtactacattattttcgtttgctaaaagcgcaattcctggaaacaataaaaaacccttcgcatttattttttgactagcaacaattgccggtgttgtgactgcaagcgttaaacttgttaatgctgttaagtttagtaaaattttttttattttttttgtaaagaacataaaatatccttagcaaatttttactcataattatattatgctaaattaaataacaaagaacaaaaacaagaaaaatacaaaaatataatttttgttaaaaaacggtaaaaattatatttttattcatattctatttttacaaactataaattctataaatataaaaaaaggggaatattaaatattttagtcctttatgataaattttatcaagacagatttgccttaaaatacaaaatatttaatattcctaaacaaactttaattaaacaaatataaaattactcctttgagtttcaattaagggggttttttattattttaaatttaaccctttgcaaaaaaaaaaaaaaaaaaaaatgattggtctgaaataaaattaagttataattagactcacttaagaataattaataaatttttgatgttagaattaaggaggaattaataatgtttttttcataagaaaatcagaaaatgcgaattttccactatttttttaaatataatggaatgccataaatttaaccgtttagaaacctacaaatttatggcttttaactattgttctttcaaaacttcaaatgtttgttttttaggctctatttaaacaagaataagctttttatttaaataaagtttaaatagtagttgtattttttttatgatttttgttattttatccataaattgatttgtgccagtgttttatactaaaaaagtagtttaaatacttcatattttgctttttaagttaaaattttagcttttttagtttgctttatttgattaataagtagatttttcttttatgagtcttagatttaaaattcagtgttttttccttgatagtcattattcctgagtttgccagtttgatggcaaaactaagacaaagggtttaatttaatacctgaaatcagcaaatgatatttaaaaatcgcgatggtgttcctagtgacccgaatatttgaaataggtatgatttttactttgatatcttaataaatcagtaaaaataggtaattaacttttgccaaaaaagttaaaaaagtgcccaaaaccggacacttttttaagattatcttattatactgggaaacttgtgaaaatcagccaattcacaaatttattaacttcaaaaattttttaccaaaaaatttttttgtgttataattattactaataagaaaaaatcattatttttagttatattcttcttacaaaacttaaccctttgctaatcatttattcttaggagccattcttttgaacttttatttcctttaatttagaagtttaaaaatttgaatctaaattaatagtaatcctttttgttgtataattatagtgttaaatctttgttactttggatcagtactcaagaagctttaagaagatatgttggaaaagtattaagggttcaagaaaacccgctcaggttcaaaacctgtctgatccgccatattagcttccgtgggtaaattgctatacaccttagatcgagattctaatccggaaacgagtgcaagttcaagtcttgtcgagagcactatgttttttaaatttaaatagactttacttattattttataaaaatttcaaattaattatcaataatcactaaacggtctataagttcgctaatgagtccttgagttagatcgattaatgaaataatagcaccagcatttgaaagtacagttgaagctaataatgctggtctaacagttgtttctatttttttaacattctttgcaagagttaaaactcctcgaagtcatttgttgacgcttccaacaataccaattgtatttccatggcttgctatttgttctttgattttatcccttatatcaaaaggggctttttgtagttgatcataaaattctttgtattttgctgaaagataagtaagcattgaacctgccgcaccggctgaaatagcagcaacaaaattaagagcaaaaccataagccacagctagtgcaaaatttatggctgcaaatgaagcagtttttacatgtgatcttcatactccggctgaatatctattataactatcattgttctgaggaattccggaggcaggtattctacggaagcttaattttctaggatctcaagggaatggagtacccatagatcggcggttttgtggtttgtatttgtatgcaaatgttactgatggcattttgactttgtgttgatattgtttttttaattggtcaaaattaatgccttgtgtagctaaggtgtcttttgcaagtttttcaagatttgcccttggatttgcttttactttattaataaaattattaaaaacttttttaaatctaccaagattgccaatttttcgcgcttctagttcaacatcttgaacatttaaaaaattaatgctagaattttgttctagttggctaataacgttattagcttctgaatctaaaaaattgttaaattcttcattataagttagacttgttgaatctttttgaagccaatttttttgggaaataacagaaattagtggaacactaattaataaactagcaaaaattaaattggttagtaggcttaggccaaaaatttttttaatatttttgttttttattttcataaatcacctcgtttgtttgaattaaaaaatttagtatatatccttattatataataaatattatataataaattttttgttttcaaatttttttctttgtttcttttcttaatgaaaaaatctggagtgtttataattttgtgttttgaatttttatggatttctcaaatagaaatctaatttaattttacattatttaaccgattagggaaaataatttctaattgttttttaattatgtctcaatttcttacctgcctttgtcattttttagatgcgttttagagcgttaaataagttatttttgaaaggtaattcacactttgaattccgcttagattatcacaagaaattattagaacatcttgcagcccacgagtttttagttactaaaaacatcaactcaattacttgctgattccctatttttagcccaaaatcccagtactctttattgtcctgccaatcaattgcaagaataagataaagtgattttttgagaaaaacaccgttttctttaacattaaaaaatatcccatcagtctacaaaattggataggaattctcaattttttgcgatttttacttttcaatttcaggtaataatttgttctcaaaactgcgatttcgatctcttggtatttttagatgaatattattactattataattcccagttttgcccgaaaacccgtttggcttattcagtctatgtacaccattttcgcttcggttacttttttcatagcctaaatgttggcttaattccgcctttaagagcgcctaagcaaaagttttagacatatgcgaaatttcgttgtgaaaatctccttttttaattttttatgatcagcgtattttatgataaaatttatcaaaacagatttaccttaaaacacaaaatatttaatattccctactttttatactaattaaagttaaaattaatttaataattttatatagttcaaataaatttaaaggacaattatgaaaaaaatattaccttttggtttgctaatgctcttgggctcaatcccagttattatagcagcttcaatcaacaaaccaaaagaagaaaattataattcatatgctaatatgaatcacaaaaaagataaagtaaacgtttctttattacgcgaggaagcaaaaaaaacattagatcatattagaaaattagatgctaaaaactttagcactaattctgaggaaaataaccccacaaaaattgttgattttacaaaatttgaaaatgattttaattctttcctggataaaattgaaaaaatcctagtgtagatttagaagaattagcaaaaacacagcttaaaacaaaagggttggatttggacaaaattattaaagaaaattctaaaaacgtcaaaactgaatcttccaaaaacaccaagattaattcagttaacttttcttcttattcaaatactgattctacgacctttgaacaattagcaaatgaaatttgaaatggtcatgtaaaatcatcagtttttgctgctatcaattatgctcttacaatcgcttatggcttttcttgaaattttttaggcgccgctgcatctggaatagccgctggaactttaacttatttagctgttgaatataagaatgcttataataaaataactactgaccctgagtgggcaaaaattaaatatcagtttgttagtattttagatgattgaaataagggttatattcaaggaataaaatactctaaacttggtattgttatcatagttaaagtaatcaatcatttaagaaatgaaatattaaaagctagaccaattttactatctgctagttgagtgtctactaatataaaaattgccattgctataattgatattattcaaaatataatttgaagatacgtatgaaaatagaggttaaccaatttaattagataatgtttaataaggaaagtttagaaaaatttttcaatttaaaattcaataattgaattttttttattccattttttggtactaatacctattataaattattcgatttacttgtagaatacaacagttttgagccgattttatattataaaaccagactaatttcatgacttttctatttaattcttaatttattttcaattattttgaccattttattatttttgttaatttttgtttatagagttcattttttttcttttggtgaaaattttgcttttagccatgaaaataaacataattttttttatgactataatatttgatttccaaatattatgaatgtggccatatattctttcattgcattttttgggttttttttaaatgctttttgagcaaaatttgttatttacttttttaagaaatttttataccgaaaatataatttgaaaaataaaaccacaacctttgaatttttagaaaattttaatttagaatcttttgtaaattccgttcttgttgacactgaaaattgtaaaaaaaagaggaagaaatcaagaaaaatttgttgaaaatatcaacataggggcacaataattagctttctaatagaaggaattcccttccctaaacatactagacgttttgttaaatataattatattaagtcaaggaaccgcaaggaaattagtgaatttgactgggttgtaactgaggtgcaaaaccattattgattttatacatttgtttttgcttcaatttttaataaaaatgaaaaaaattttaacagaaaaaagtttttctactacttatttaaaattttatttttttatattttatcaatttgaattcttcttttttcaacaatttttgtattctttaatcattttcttcttgatgaaccgacatttttgttaaaaatttcagcattaggatctgttattgttgtcatttttctattcgttgttatgctaaaatctaagtttattgagtggacataccgccgcatcaaaaagcgtttttttgacgctaagctaattaagtctgaaaaacaagattcaatataactatttttttaacaccattatctaaatgcccttaaattagtggaaaaattcagattattgctttttatttatgatttttattccactgtttttgttaatttttggcattttatttttaaaaaatctgaataaataacttatttaatataaaatttgagcctttatatgaaaaagcaatagttacattttcaaaatttttacttcaatattggttaattttcattggaaaaacccaaaaaattcaataaaaatgattgcagagttaatcctgcctttctaagaacatttttggattatttcttgataaatttaactgtatttccaaaaaacccttaattttctatttcttttttgtgttagcgggatttatttttcatagacttatcaaacttttttgccaatttattattaaattgtttcatatacatgcaaaactgaccgtttgtgtgaaattttacatttttcattattgattttttataaatttccctaaattcttctgcaaaatgtaaaattttgcttttaaaacctttaaattccacaattttgctgtatgcaattttgtctcaactgttaattttaattgtttcattttaacaccttttttgaatcaactaaaaccaacatactaatttatagtttatctaattttacatttttttgtctagtctcattttttatagtaaaacttaactcataaacaatttgtaaaggcaggccggattatgaggtttagcatttcaccaagagagtttcaaaaggaagacaaacaattttattagactataaaagcaaaaaatattttccttttgtaagcggataaactggcttagaaaagaaaaaatccttataaataaaggattttttcaagattaaaatattaaactatcagatggaattttatatatggcgcgcccggaaggagtcgaaccctcaacctcttgggccgtaaccaaacactctgtccaattgagctacgggcgcaataacttttggaggcaccaaccggactcgaaccggtacatcaaggtgttgcagacctatgccttaccatttggctatggtgccagaaactaaaaatatttttacattgaaattatagcagaaaaaattaaatttcaaagaaattatttttttatttttcttgctgtcccaaaattcggattagaagttcgattagctcctgtttttttaaatcttgatatccagaaatttctagttttttggcaatttcatataaatttgtcaatggtaatttttcaagtgcaattctaattttttccgtttttgaaattggtttttccgtttttgcattatttatttcattatcaacatttaaatcagaaggatttgtagtattattttggtttgtctgatgcggattattttgagccatactaaaaatatccatatattttgagtaagtttggggatcattttttagttcattaatttgtttttcaaagataattattgaatgtgatagtcgaaaaattgatttaattttcaaaactcttgtataaaaataaggtattaaaaagaaaacaagcccgacaagaataatctgaattactaaaattagaataaaatatttgtcatctttttttaaatctttaatcattgacactgttgaatgcaaaattgaaattaacgacaagctaaacccgattaaatttacaaaaaaagaccgattgccaagactagcaaaatccttttctttataagaaataaaaagcgaaatgatataaaaaaataaggtagcaccagtaaataaaattgacaaaattgataaaataagttcaatccttttggaatcaaaatttaatatgatttgcacccctagtaaaattgcaagtaaagcaagtaaaataggataggtaaaaattcaaatccgatattgttttttttcattttttcacaattctgccactgacgggatttttttattaccaaatggatttcctaaaatcataaagtccttaaaaaattttatttatttacatatataattataattcaatttttattaaatattataaaaaaataataattttaagcaatataaatttgctctttcgtcttagttaaataaaagttcctattattatatgaaaaaacccggaattacaccgagttttttcatatggtggaggtgcggggaatcgaaccccgatccaaataaaaaaaattaatagagtcgacagtttaaatttatatagaaataaaaagtttatttaaaattaagaataagtaaaggagtaagcattcttaaataaaactaaggaggataatcttataagtttgataagtttgattatctaaatttaaatatttttcaagttacagaaatgggaggcccgtatacatgataaaatttaaatttttaaggatatattataataaattgattaaacgtatgcaaaatttaattggttatatgataaaaatgggtaatcaatttttgcttcgtttggagatttttttgaattttttgcgttttgattatttcggtattatggtctaccaaaccactgcatcttagaaattttttttaattgtcaaaaccaaaacacccccatttatattagatatttttttaaaaaaaattgtaaaaaaagtttttacaaagttaattataacataaattttaaaaaaattaatttttttctttgctttttttattagctcaaatgataaagtagaaaaaggtatgattgtgttaatttttttagttttgatatcgtatatataaacaaatttggaataataaaccaaaaatgtattatcgtgaaataaaatcctaatttttaatatttaattgaataattttatttaaaaatttaaattatttggtatttgatattcctgctgggaatcaattttttgttttcttatatttttattaaattgattttttactaaagaatcatctcaatttgattcaatttccagttaataataatctaaaacttgactttttataaaaaaaattaatttattttttgggccttagctcaaattggatcagaaaaaccgtagtttttaataacgccaatgatttttttttcactatccttattattgccataaaaattgtcatcaaaacctaaaaatgttattttcttattcattattctatcaattaaaatatttgcaagctcaacaataaatcactttgtaaaattatttacaaggtcaaattcaataagtaaaattttaacatttcttaatttatctaataaatttagtttattttcataaatatagtgactaatttccgacaaactaaaaaaaccaacattatttgagtttttcgcaaaaataatagcaaaagattttaaaagttctgaacgttgaatactatccccaccttttaaataaattaatttatgggtagttatcatttttttaaatgagtttttatattgttttaatggtagaatttttttagattttgggtaattttcttttacatatttagcaaacttttcagcatttttaaaacttatttctggtaacaaaaagtagtcaagccattttttctgaacaaaattttcattatagataaaggtagttttactcacaagccttccagtgaataaatttcgcactatttcgtatttataattaggtttgcttagaaattggattgctagccaaaaaagatcaagattttcgataaattcttctttagtaattgaaagattttgtattcattttgcaaaataagggtttttctgtgcggaatcataactaaaatcaagttgcttttcatttctcatattgtgtttgcctattttatttttgtttgttaataattgattattgaattattattttgattttttaaattaaaaattattttcttaattttcagattattgtttttttattagttaaaaatacgctataattgcattaaaaatttaccttataaaaaactaaattaatacaaatttgataatttaatatttttttctttagagtcaaccttcacctgaatttaattcatcaacaattcagtcaatttcccctaaattattttttgtttctaaatttgaaaatttactatttttttcaagttgtttttcatcttcgatgtaaactaaattatttttgtttttcaaaataagtaatttttgactatttttctgtttctgtttaaaaatttcttttaattcaatttcaacatctttcccattaattattttattatctcataaatcatcaagaatttttttcatataattaaaaattatttgattattagttttataacaataatcaattacacagttaattgcataatttgaaaaattcctttcattttggtatgcttttaatgcatttcgcacccgtggtcgtattattttttttgctagatatagatgatagtcctcaaaatccaagcctttttttgctttttcattatcaaaatcttctggaaaagtaagtaaattattaattttttcgctattcaactcaaagagttcataaaatttttttgaaagattacgtaaatttaatgtatcaatttgcttatttttactaattttttgtgtatttttaaatttttgaattaaatttgtatatgtggataatgttattttttgaacaattaatgatttaagatatggatttttatcgatttgatttgaattcaatggagcctttaaattaataaaatattttttttgttcagaatcataaaatgtttcaatcaaatttagtgattctaaaatttcccgatttttattaaaattttcaaaattaatttcaaaaattttttctaaaaattcataatccactgtctcatcaacatttttaatacttaaaaggtatcgaaataatgtagagcattgcgatccaataatcggataataaaagtataacaagttatttaaatcatttttgttaaaatcaaatttagaaattacaaaacaaggatgcataatatttacaaattttattattatttaaaaattttagaaaaaaattttaggaaaaatcccggttttttccattttcgattggagattttgacatcgtaaaattgaattttgcccgtgtttagggcctgattttttaatttaatatcgtttttgactttttttcttttaatgtttaaaagttgttgttttttactggtattaattcaaaccacctttgaaaaaaatttgccgaaatttgcattctttgttcataaattcggtatttcaacaaaatgataatgatttttgcttaaatgattttctaaaaaagggtatattgatttttcgatcagatcgcgattttgcttactttttaacataaaattacgaattttattcttattaacgatattttcattaataaaatctggtctgattttcttgattattttaaaacattctccgctagctaaataacaattatgaaaaaattcatctgtatataagacagaataaccaaatttttcaactttcttcaaaaaagttgtcttcccactgccgtatttaccaacaattgccgcagattttggctctagaatgaaattattaattacttttgcaaccccaaattttcgtttataaccgataaaatcagcattttttttagcattttttgcacctgattgcataattattaacatttttacaattttttttgttgaaatatcattttcggaatcaccaatatgtaaggcataatctaaagaaatattgctaaatttagtgataaattcgactgcttttccttttgaagcgctaatatccgtaatttcgataactctaaattttctaatcaggcaaatttgaagattatcagaaaatattttttctaaaacgtaagcaaatttcttaatttttcaaatattaaccgaaaaaatcaaaatttttctaacattttcagggaccaaaatttgcctaaatggtctaaaatcgaaactttttaaaaaaaagttcaaaaattttataaacaaatttttgaaaaaaaatactttcgagttaaatgaaattacaaaattaaatctttttgtaatttcaataattttactaataatttcttgtttaattccagttttaaaaagtgtgctaaaatttttatcaaaaatttcagcaccattttgacaaatataaaattttgccttaatttgtctaccaataagggcaactttggaattaaattttcttcctgttgaaattacaatgatacatttatttgctaattttctaacagcatccgaatttttctttgaaattcatgcttttctacccctgccaatatctaaaagtgtgccatcaagatcaaaaaaacaaattttatagaacatatttagctcaattttttagatttttaactataattataataaaaagtggtaaaattattacttaatttgaataattatttgtttagatttcttaaaaagttttaaaaaactatatattataatataattttaaggctacaagttaaggattttatttttatgaagaaacaaaatatatttcagaaaattgctaatttaaattctaatataaaccaggaaaaaccaaaaaaaactccaaaaaataacaaaaaagtttggatttcaattattgctgtagcaggttttctaactgttattggtttaggtgttggaattccgctagtttattcaaatgttcctaaaaattttttatataaaagagatccaaaattagatattatccttcttaaatcgccaaaaagtaataaaaaccttaaagttgaagacttattaagtgtttttagatccaatcatttaaaacaaaaagaaaatttagaagagggtcagaaatatttaatcgaatttctttataatcaagaatatcaagcatccaaagttttccaggcagcttgagaaaattctaattcagataaaacgaccgggaattcccgtaattttgctcttgaatcatttgctgaaatccgtgaaagtcaagtaaaatatcttcaagatgaaagagctagataccagaaaactttcggctttaataattgagaatctgaatttaacaaatatctaaattcagattctcgttttaataatgccattaattttgatcaggcagttgatgctcttacaattgaaaaagctcgtgatgttgcttttggccgatttaaacttagttttaataaaaattttaccaaaagtgatattcaggaccgggtattaaatgatgatatcaaagatgaaaaaggcaaaatagtctataaaaagggtgataaattatttaaagatattatcgaaatcggcataaatggctttattccaaatattataaataaccaaaataataaaactgaagagcaaaatgtgactgcttttttaagcaactcttatataaaagagtatatgaatccccaaaaaattattaatgagatctattttgatgaaaaagcgcctttaaaaggaaatttcaatttttttgaaatttcccagattagcattaacgcaaaaccaaataataaggacgcaaaaacaccttgggatctatcaaaacaaacacttgaagaattattaacttataaaattcttaaaacagatgataataccgaacttgccctaaaagtaagtaataatcttgaattaattgagaaatttcaaggcggaaattctgaagatagtagccaaaataatcaggacaaaattctgctttcaacaattgattatcaaaaaaacaaagaaaatgctgctgtttttggtaaacagccaattgcatctcttaatcaaattcttaataataacgaggctggttatgtttttgctttccttggcgattttgaaaattcagagaagactgataatctttttagcaaagttttatttgaaaaattaaaacttttagtttttaaaaatagtccaagtttgttagttgaacctagtttattaaattcaaagtcaattactgaaatcaaatccttaaatgaaagactaaaaaacttcattcagggactttcagataacgaactaaaagaagctggcaaggctttcttagaaacttttggggctagtcaaaatgatacgcgtaccaaattagtctataaaatacgggataatttaaatgttgtccttgattcaagtgggatgaaagtgcttgcttataataaaattgcaagtcttgaagaatttaatgaaattattaaaaaacagttacaattaagcgcaaataatcaggtggatcccaaacaggatgcaacaattaatttagaccaactttttgctgatatttccaataatgatttcattcaggcgctattaattcgcaatttagaatatctaaagaagctttccgaggcaaaaaaaactcaatcagaacaagataaaactgaatttttagaatcaattaaacaatctgcagctaattatttaaatttttatattcttgatcaggttttaaaaatcaatgcaaaacttcaggattatatctcaaatgcaactttaaatgatttaaatgccgatttttggtataataatcaaaatgagcgttgggagctaagatcagatccaaatactgaacttcgtcaagcgataattaagcggcttgaaagcttgtttaaatttagctattaaaagaaaggataatttgtgaaaactcgattcaaaaagaaaaaaaactggtatacatctctattttttctagtactaaatttttcctttcttagtcttagtagctgcagagttataactgagacttcagaaaaagcacaagaagataaaaaaattagttctgaaattgtaaaaaattatatcgagaatgcttttgttgaaaacattttacaagaaaatgttttcaaaacaacaagtccaaaacttgttttagaatttgaaaatacaaattcggaattttataaaaatacaaaagaagcttttaatttttatcaaaaataccaggttagccttgatccgactttttcacttaaattagtcgctgatctccaggaaaaaaacgcactttcaagcgcagattttgccattctttcagcccaggcaggttataataaattatttgatagtcaggcttttattattttatataaaaattttgctactggaatttcccaaattgttaataagatgcttttagtaaaatattatcttgttagtcttggacctgatttaataaaagattcacaaatttataaggatggaattgcagcttcagcctcttttacaacaaaggaaatttttgaaaatatagacccaaattctcctgattttttcctaattcacctacttttaacgaaaaatccggttcaaatttgacaatttgaatcaagtgatcaaagtagtatttcaaccttttcacaactaaaagttaaggatctaaactcatttaacaaccttttacgcagcgaaaatattacttcaaaacttacaagaaaagaaaaagactttgaaaaattagcaaaaaatgatagtcttgatacaacaaatatgcttggatatgccgggattttgtatcgtcaagatgcaaatttagcagatttaagctttcaatttgaagatttacgcaagcaaggcgaagtcaaatccggctttttagatccacagtcaaatcgaatttgatcttctgaacaaattagaaattttagcctaattaataaagcgaaaatgtttccagtagaactaaggccaaattttgactttaaaacaggtaaagataaggtccaaatttctgattttgaaattaaaaatgataacagtcttcctgaggcaaaatataaaattaaagcaattatcccttctcgagaaggttctggtaataatttttttgttagtgtaattgttgagatcgaacttggttcagcaaaatatttttataatgttgatgttagttgggatgagacaaaagcatattattatcctgaaattaaaccccaaggtgaagatcttccaaaacttagtcaaggaatcccaacaacttttaaagatctttcaaaaatttcggttaaatacgttaataaattagcgcctttatatgataaaatagtgcaaggcgaaaacggaaaacgagcctatttttctcttgaaaatacaccttgaaatacccaagaacaaaaaataaaactcgcttattctttatatttagccgatgagaccggaatttatcgggatgcaaaaaacttttttgaaggacttggttataaaattgaatcaaaagacgagattatcaaactagattagcgctaaattttactaaattagacaggaaattatggaaaatactactttatttctagatataattgcaaaaaaattaccagcaaaaataatttatgaagatgaaaaagttattgctttttatgataaatttccagtttcaccaggtcattttttggtcgtaccaaaaaattattcacgaaatttatttacaattagcgatgaggattttacctatttaatcaaaaaagcacgtgaattagcacttgttgagctaaaaaaattaaatgcaataagttttaaattattaatcaataacgaaaaagaagcacaacaaacaatttttcatactcacatccatattattccgttttataaaaaagattaactagctaattatcacaatttaaaaaaaccaaaaaaatttgaatttttgttttttttattccttttttaaataaactttattgatttgatcaactaaattatatctatttgtcttaagtgcaattcccgaagacatatgcgaggttaaacgaaattgatcataaaagagagatctaacatttccatttattgttaaaatcgatccatttataaaagctaaagttccatcggcattaaatacacctgaacctgaggctcctggcccattagaagcaaaaaagtttgccgaaattagtttagggttttgtgggttcctgcggaaattaacacctttaaaaacgttttttgaaattaaattattagcccaaaacatcccaatttttgttgtataatcaaagtcttgatcatctcaactttgttcagaaattttagttggttttaattttgaaattttttctcaatattttttaaattcattaaaatttgatacaaatttctcaaattttccatttgctagggtatgaattgtcttaattaaatcttgatgattggtctgaaaatattttattaaactttcagtttcactaataaattttgaataattaaaataaaaaacagcaacatccaaaccttgattatcaaaattaggaacttcaaaaaagttgttatataaattttgcatataatcagttaattctttgattttacactctcgacaatcaaccgggaaaagttctttgccattatctttgagtcattttgtttcccaaagacgaaaaagaatccgattatctagttctttaattttaaagtcatcatagtattgtaaaaatttttgtaagttagcattaagggaattaccggtaattttggtattcattacttttcaaaatgggccaccgttatggtaaggatataaaacgtgtctgttagttaaaaaagcggcttttccggaattagcgtttaaaaaaactgcagttccaggggcaaaccgaatgtttcgagtaaaaatatttgcatatcttttttcttcaagactatctgatttaaatccaaagtaaggtagaatataataatttcctagtctatttgggttaaaataggaataataatttgcttttgcattaacattatcgactaaattattattcattttttttattagaaaaatatttaaattatcatttttctgacctaaaaaagtagtttcattttctttttttataacattttcccaatttttaagctgatatttataataagttggcgttttagcaatattttttacctcatttttgctaaaatcgctttcgctggcttgtgttagttcattaacattaatttttgttgaatttggatttaccttagcaaaatcaaaactagtttggtctgataaatcacttgtagattcggaccaaaaattgctatcagtggtttgattattttccgttctttctgttttttctgttttattttggctatttactacatcttttttttgggtattttcttcaactggacttacttttgattcttttgttggatctaatttatcttcacttttttcgggagtttcttcacttcttatttccggtaatatttttttcttagttttgctagattcaattttataagtacaacttagaactaaaaaaggacttatagaacttaaaactagaaaatattttaccatttttttcataataactctcgcttttacattaaaaaattatcaatttttactttttaaattttaattctgttaaattaaaaaacataattaaaattataacaaaaaacaagtaaatttattttttattttagatatgccttataaatctcatcaactaaattataatccttagttcttagggtaagtgcagatgacatatgcgaagttagcccgaattgatcgtaaaaataaggcccgatactacttacacctaaaattgctttgtttaaaaatgcaagcgaaccatcagtgttaaaaattccacttcctgaggctcctattccgttggctgcaaaaaattttggtgtaattacatttggattgttacttgaattttcttgatcttgaggctcaggagaaaaataaactcctttgaaaatattttttgacacaaaattttgtgcccaaaacatccctatttttgttgtataatcaaaattatcagcttctcatattttatcagaaattttaagaggttcaaattttgaaattttttttcaatattttttaaattcattaaaatttgatacaaaattatcaaatttttcgttagcaggtaattcaattgaatttacaaattcttgaccttttgccctaacccgatttattaaatcttcaatatctttaatgaattttgcataattaaaataaaaaattgcaatatctaaattattatttttaaaatcatgcttttcttcaaaataatcatcatataaattttccatatacctatccaactcgtcaattttgcctcaagcgggattatacggaaaatttttatcatcaaatcatttaatttctcaaagtttaaaaagaatgcgattatcaagttctttaattttagaatcatcataatatcgcataaattttagataacgaggattgatttggttattttggtcttttttattcattagttttcaaaaagtttgaactgaatcaccaataacgtgtttgttagttagaaaagctgctttttcagaattagcatttaaaaatacagctgttccagcgccaaaacggatatttcttgtgaaaatatcagcgtattttgtctcttcaagtgaatcagatctaaaaccaaatcaagggagtttatataatctagattctatcccccccaagataaattaaaatacgtaaaaggatttttttgggctctaatatcgctaactgaaatatgttctgtattttttagtaaataaatatttaaattttcgctttcttgacctaaaaaagtagtttgattttcttttcttataacattttcccaatttttaagctgatatttattataaactggaggtattggctctaaggagtttttatcagtctgacttggatctaattctttaaaatcagtttgattagtttgtgatagtgaattagtattaatttttagtgaattttgattaatttgaaaaaaatcaagactagatttttctttttcttgatttttttcaagttcaggtaaaattttattttcttgttctttcttttcttggtctaagctatttgcctcctgtttttcttcagtttttttggtaatattctttttagaatcaattttatcattacaacttagaactaaaaaaggacttaatgtgcttaagattaacaaatattttagtgattttttcatattttagaacccctttaaaataaaaaatttaaattttttaaatattattttaattttatattataatatttttttattaataattaaaattaaatttacagaaacgagataaatatgacgcttaaaagttcgcgaaagctaggtttttttgcagccctgtcaatgttagtaagctcggttgttggaatcgggattttctttaaaaatcaaagtgttgcggatataacaggatataatggttatgcttgactttttgcttgaatcatcggtggcataatttcactttttgcggcaattactttttcagaaattagctttttaaaaccaacaaagctcaacgggctgccaaattgaacctgacaaaccgctggtaaaaaaatgggttatggtgttttatttaattatagcttttattattcaggaattctaagcatagttttaggatttttttcttctgaaataacaattttctttcttcaaacagcaggggctgatattaatgttccagtttgaggccatctaataattgggacagttttttgtatttttttcactagccttaattatatttcaataaaaacatcaggatgaattgcgcttgcatcaacaattttaaaatttattcctttagtatttgcagtttttgcaggaattctatttccaaaaacttataatgccggcggttctaatgcctttgttcaaacagctacaaatagttttaattttgcaaaattaattcttgctttgcctccagttttatttgcatatgattcatttttatctgttggttcaattcataataggatcgaaaaagcaaataaaagagttccaataattattatagttgggatgataattattgcggttgtctatactttgattggtttatcatctgcattgcataatcagggcacaattagtggcttgattagtgatgtttttccaaaaagttctgcaaaatcaattagtatttttgttggatttttcctactaatttctacatacggtgtaacaaattcccttagtgcaacctatgtaaattcagttactgatttagttaaattaaatgcgattgttggcgcatttagtcttaaaaagaaaatgagtcaagtaaaagtgacgatttgttaccttacaataattttatttttttgggctttaattatttatatcccttcagtttctgtaccttttccatctgctaataattctggttctggttatggtactgatgttgttgttgattcgatgtccaattttccaacattaatttttatgtgagtttatatggctgttattattgcttatgcacgaaaaagaaaacaacttatggattcatcaaagcaaataaataaaacattattttgaacagctgcaataatttcttctatattaattcttacagctatggttgcatatatttatgcacaaattgatgctgtaacaaatgaaaaaaattcaagttcaggttctggtgtttttgcagctaatgggcttattttaacaaatcagggaaatttcttaattcttatttttcatttatttgtttttagcaccctccctttcataaattatttattaataaaaatagttgataaaattaatgtacttgattattttaaagctagcgaaattgaaaatttagaaagcaaaacaaccactagaacataaacttaaattgttaataaaataaaattatcacataaaaaaagcgctaatttagtgctttttttattgaattagaacaaaaattttattttaatatttatttttctattagtaagactttaaaaaaccctttaatttatagtattttttatttatgttggttttaataatttcatttttataaaaaaaactttttattctatttttaggtaatttttttataatttataaaatttaattttaacagggagtcaaaaatggactttttaagtaaaaagtttcttttttgtggttttaataagctaaataaaatcactaaaaatttaaaaaaagactataaatttatagtctttttttgttttatggtcgataaaattatctaaagtgcataaataattaatccaagaattagacctgctaaactaggagcaataatcggatttaaggaataagaaaatccaaaaatctcttgccaatttttaatggcagcaaattcctttcttctttttaaaactagattagcaaaaagaaaataaactaatcttgggccaaaatcacgggcgggattaactgcatatccagtcgaagatcctagtgaaagtccaagtgagagcacaattagtgcaacaattactggtttcattgttgaaaaagttttatttaataaaaaaattgctgctaataaaacggtagttccgataaattcatagaaaaaattagatatatatgattttttaaaagcagggctagtatgatggcaggcagcgataatttctgcttttgtttcctttatatgacttcagttgataaaatttagaataacttgagcaaaaattgcccctaaaaactgaaaaggaatcagcgcaagtaattcgctattttgaaaaataatgccaaaaaatattgaaactgccggatttagatgagccggcgcattttcgataattccatttgaaataattattcctaaaagtaccccaagagctcaacctagtgcaatcacaattcatttcccagattgatttgcaaacattttagtcgcatttacactataatttacgccatttccgagtaaaattagtatcgcagtcccaagaaattctgataaaaaaaagagattattcatcttggattcctttttatttaatatcttttttccaatttagcgtttttctaacagctaagtcccaattggaggttaatttttttaccataaattggtcaaattcagggacaaaaactttttcaggaactaaaatttgctttaattcagctagtgaattccaaaatttggcatataaacctgcaagaaaagctgctcccattgctgttgtttcaatattttttggcctttggatttcaacctgcgaaattgatgcctgaaattgcattagataatcacttttagaaactccaccatcaactttcatcaagctgatttttgttcctagatctgattcgatcgccttaattagatcatttgcctgaaatgcaattgattcaagacttgctttgataagatgttctttttttgttcccctttcaagtccaaaaattgccccacgcgaataggagtcccaataaggtgccccaagtccggtaaaagatggaacaagaataatatgataatcattttttttagcttttgagactaaagaatcgcaatctgaagagttttcaatcaaagaaagtccatctctgagccactggattgcggctccggcaataaaaactgatccttcaagtgcgtactggattggattatttccgatttgtcaggccactgttgtaagtaaattattctttgattttattagtttttcaccagtattaactagcataaaacatccggttccataggtatttttaaccattccaaattcagttgcaagttgaccaaataaggccgattgttgatcaccgattagtgcataaattggtacttttgcttttgcattaattgatcaatgaaaaggagaaacaaatccaaaatcatctgctgatgctaaaacttttgggagaatactgtaaggaatttctaaaagatcaagaattttttggtctcattttcgtttttttatatcaaataacatcgttcttgaagcgtttgttatatcagttgcatgtacttttccgttagttaattttcaaagaagtcagctatcaattgttcctgctaaaagattaccagcagctaaaacttcctttgcttttttaacattttttaaaattcagcgaatttttgtcccgctaaaataaggattaataattagacctgttacttcttttatataattttgataacctttttcaattaaataatcacaaaaatcactcgtgcggcgatcctgccagacaattgcattatagactggctcgccatttgttttatctcataaaacgacagtttcccgttgatttgttagtccaagggcaacaaaatcagtcgattttaaccctgcttttgtttttgctgcctgcattgtatagacctgagtattccatatttcaatcgggtcatgttcgactcatcctgatctgggaaaatgttgactaaattctttttggacaagcgaaataaccctacctttttggtcaaaaatcaaacttcgacatgaagttgtccccgaatcgagggtgataataaatttttcagctgtattttttagcatttttttaaatcctttcaatttttatatatttgaattataacattttaatccaaagtagccctgtgaaattaacaattttgttaattttttaattatttttgaaattaaatcttataaaataataaaatttagaaatttcattatttttttataaaaaaaatttataattcttccttctatgatataataatttcaggtaaacagaggtgtccatttttgggctgagaaaaactcttattagttgacctaggtaatgctagcggaacgagtttgtctttttttaattgaatcgtcataaaacaccttagtttactgaaattttaaaaggaaaactgatttatgatggttaaaataaataaatttaattcgaaaaaaaagcatttttttaaaaaaataacttttttttcgtcattttttctaagttcactgctttttatttcagcaggctgttcatctacaagtaatgaaaaagtagcacaagtagcagatcttgaaaaaaattgagatacacaagtaaatcttggtcttggtcaaagttgatttgaggcaaaatcaaaagatccagatcgggtttcaaaatttttagaaaatttgaaagccgagtttaataaattaaaaaatgcaaatccagatacaaaggatttgccaaatgtaaattttgattttgtcggcattgatgattcaaaaactaaaatatcacaactaaaatcttcagataattcaacttcagcgattgattttgcaatcattgatgctaccacaacaatcgaagacgatcctgaaaaagaactttataacggactgcaaactttaacttgagcttttaaaaatagttctgatagtccagttttttatcaaaatgggactaaaaatgatcctttacgccaatcagctaaggaattaagcgatctttttaataaaattccctatgatcaatggaaaagtactcaagaaggcgagcaaaaatgagacggtattgcctatcgttttttatatgataactctagtccaaaacggataatttcatattatcgagggatgattatgatagcaggagatgattcaactcgcgaagagatcaagaaagcctgagatcaaaaagactgggaaaaatttcgaaattttggaattatccacggaaaattaacctcagctggcaaattcaaaatgcaaaattttatcattaagaaacattttggtgctaattttccagcaaaaagtctaaatgaagataggataaaccatccggataaatatcttcaggcttatggatcttcaattggacaagatccaaaatataaaattgcctttgatgatgaagcttcatttgcttgaactgaaagcaaaaatgataaaaaacagtattattcaaacgaaaaagacggaaaaattgagattttaagcctaactaatcccgcttcatatgatattggttcattccgtccaagttttaataaaattcaggccgatatgattactgaagcttttgtaaatcttgcaaagaacgacaatgatagttatggaccaaatgttggttataatggatacaaaaaaataaatcaaaaagatcctgaatttcgccggatttatgcagaatctaactaaaaaattctgtcttgaattaaaaaatttttcttataaacatattaaaaaaagcaaaaatttagtagaaaatctaaatttttctctttgtagtggtgatgttttatttgtgattggcccaagtggtcagggcaaatcatccttgtttttagcactttttcagcatattttaacttcaggcgagttaatttttcaaggaaaaaatttattaacagagtcaaaaattaataaaaaaaaagtggccaagtcaattggatttttaagtcagacggctacttcaattaattttcagagtgtttatgcaaatttagtcaaaaatttgccaaattataaaaacattttttataatttatttgcaataccaacaaaaaaacaacacctagaaattgaaaaaattcttgataaactagggctaaaagaaaagatttacgcaatttttcaggatttatcaggcggtcaacaacagcgggtagaaattgcaaagctgatgttacaaaatccaaaaatcattcttgccgatgagccaacttcagcactagatccgaaaacagcaaccaaaattatcgatttaattattgaatttggaaaaaaaaataattcaatcacattaattatttcacatagcatttttttagtaaaaaactataaagaaaaaatattacttattaatgaaggtagaggaaaattttataactcattttctgaaattaatgaaaatatgatcgaattaatttttggtgaggaaaacaatggctaatttattccctaataaaccttatcaaaagtttaaaaaatctagaatcatcctattttcgatctttataattttatttattatttctttttattcaattttttccaaaattaataataacggctgaaaaatttttcagaagaaccttagtaatttatttagtttttcaaatattcacccttattataatgattcaatttttgctttaagttttaaatttttatgaattacgattaaatacacgcttgctggaacgttttttggaacaatttttgctttttttactgcaatttttagctcccaatttattaaaaataaattaataaaaatccttatttggtgagttattataattttaaaaagcttcccaattatttttgtaatcgacccgatgcggctaattttcgccccaaaattagcagcttttttaattattttctgatttagttgaatttgactacaccgttattttcattcatttttaaattctcttgacttaactagttataaaaaagcagttatgagaggccaaaattggtttatttcctttaaaaatgaagtttttccctttgtggtcaacaaattttttgggctttttttgtttagttttgaggcaaatatccgttgaacaacaattatttcggcaactggggttatcggaatcggaattttgatcaatgatggtattcaaaattcagctctaggctggaaaattattggaattccccttttaattcttttattttttactattatttttgattttttaattattttttttaataaatttattctacataaaaaatctgttgacatccggcaaaaaaattcttttattttatgaatcaaagtcaattatgaccgaattttaaaggctttttttataatttttttattaatcttaatcattattagccttactgatattgaaaattgatcggtaaatacttatcaagtcaagcgtttttttaattccttgtttgtttttgattgagaagtttttttacttggtaaattagataatcctctttatatgatttgacatttcttttgccaaatcattgtttgtttgacaataattgcttttatttcaattttttttgcaattatggcaaacgaaaaattaaataatttaccaaaatgactgatttttaaatttcttttaaatctctttcgaatcatcccctcaattattattttctatctttttgttagtttcacggttagacctattttgtgagttacctgtttagttggttttaaaaatggaataacgatggcaaaaaagctcaatgagacactaaattcgcttgactgagagaaatatcaacttttaagattaaagcaatgaagtaaaaaaaaagcaataattcattatatttttccttcaatttctcaagaatattttaaatatttaactattgaaattgctaattcagcacatgatttactcctttatggaatttttggtggttcaatgcttgggcttaaaatttcaacactttcacagacaggaatatccggtgaccgtggtggtttttttacttattcatggattgcttgatttttgatattaattattgaagttactctggctctaattgaaaaaaattatttcaaaaattttctctatttgaattcaaaattttggaatattttactaaaaacagtaagaccgaaatttttctcaagatttaaataaatatctagtttagtttcttgaaattaataaaaataggaaaaatatttaatttttcctatttttttcttttttttcaaaaaaaagcttaaaaaatttaatttaggtaaatgcggaaagcacatattgttagtttggttattctaattggcggattaatcggttttggttttataacatataaattacaatcacatatcactccaaaaaaacaaattgcgattacaatttctcacggggttcgcaatccaggaactaaatttttcgactatggggtgaattgacggaaagtttttcaagaatttgatgttatccgtggttatgatattagcaaatataaccttgatttaacagtgaaaaacgatcaacaagtcgaactaaaaccaagtggttttttaacaaaaattgagaaaatttcgcttaaaaatgcggaaaaattaaaaataagtcgagagatagttgaaaaaatccgtgattttttaaaagaaaataaaaataaaaaattaacttgaaaagaattggagtgaaaattagaagttgattttgaaacactaaagaagctgcaagaaaattttactcttgactagcagtttttcttgggctaattttcctgattttaacagttgataaatttaattttttatgaataattttattgttttttctaattttttttctaataattctctctgagtttaaaaaaattcttatttttatgtttttagcgggaatttttttaataatttattgactaatgacacccaaaattgataatcaagctctaaattttgaagctaaagtagttgataaggtgagtttcggaaattttgttgaatataaatctaataaaatttttattcggggacaaaaccaggaaattggaactaatttatgaatatcaggtgtattatcccgcccaagaaatcaatcagattttgatttagtaacatatttaaaatcaaaaggttcacttttagttcttgataatccaaaagttaccgtgcttgagacatctaaaaatatttttacaaaaataagaaatttttttaaaactgatggtagatattcaaaacaattaatcccgatgattttcctagcagagacacctccagaagcaaatgattttcgaaaatgacttgtaaatcttggtatttatcaaatctttgttatttcaggttttcatattaacctttttaaaaaagcaatttttggagtttcgaaagcttttaaaatcaagccttttatttataagccgattttttttgcttttttattatttcagttatttctttttaattttgctgtttcttttttaaggggttttattttttgaagtttaattgagattaataaactatttttaaataaaaaactcaataaaattgagctattatcaattagcgggatagtaattttatcaacaaatccgttgattttttattcaattggttttgttctaactttcacaatttcctttgttattttaattataaatcaaataagcttttcgaaaaaatgacataaatttatagtgcaatttctatttattaatttttttagcgctgctttttctgcctttttaaattcccaatataattttattgcccctttaaatgtagcattgtttactccattttttacgcttttatatacaagtttgtttatttttattttcaatccaataattattgagtgaatatgtaaaagttttattcaaacggttgaatatattaacgattttcagtttctaacttgaaatattagaccaagcttatcatttttgcttttttcttgtataatttcgttaatatgttttttgtctttggaagtgacaattacattgtccagaaagaaatttcaacaatcgcagaatctgaaaattctaaaataattaattttttcattaatgattcatatgaatttattaagaaaaatattattaatttttcgctctttgacaacaaaaaaacctttgtttttaatgattttttatacttttcaactgatgagagcgcaaatgaatttttaatttcaaaaattaaaaatacaaatcatacaattatttttaagtatattcttaatgaaaaaaattctctttctatagttaaagactcaataatttataaatctttttcagataaggcaaaaataattcatactttggaaattaaccaaaagaatattcttgattttatcaaaattagcctaaaaaatttaaaaattaacttaaaaacaagtgaaattattgagcttgaatcacgcctgccttttaatggtatgataattcaaagtgaattactaaaactaaaaagtctaaatttaccaataaattctaagataattcataattttataagcgattattcacgccattcaacatgaggttttattaattcatttgtaagtttggatttaaaaaacaccttcggattttaccgccaaaaaatattagaaggtcaaactttaagtctgttaattgggcagataaatgcaaaattaacgcttagttttttgatttatcttgaaaaaaagcttggtcatagcaatttagaaatttctcagaaaatgggaatttctaattttcaaataaacaaagcaatcgatttatataccaaaattagtattgaaaaacttgaaaatatgataataaaactggcaaaattagatactctaataaaaaaatcacaagtcaatgataaattagcttttgaattgtatctacttgacctcattaaatagttttttttggttaatttttttgtttgttcgggaacaagatgaataacttagaaaaaataatagatttttttgttactttttcaaaaaaaaatgtataatgagggtaaatgttgagcacaaccgaaaattatttgtggttatttggtcaaagttttacaaggattggccgagataattttgataattttttgttgtgctttttttataaaaattttatgggggaaaaattgtagttaaaaattttaatatctaattataaaaatataaattcttgctaactaattttagaaataataggaactttttaaaaaaaaatgaataaaattcaaaaaattaaatcaaaatttttaaaatcagcactaattttaagcacaattttttctgtcccacttttaagtgcggcttcttgttataaatcaaaaaccgaaaatccggctacacaatcacaaattaacaacccgcttcgttatgatactgaattagataattcaattgattttcgaataattttttctggatcagatccaagaaataaagctttgaccaaaattttacagaaatgaaacgaaaaacccgaggtaaaaaacaatcaacctggatattttcctgccaaaattgatcaagctattgcaaattatcaagatgatcaaacttcacttacaaattatcttgaggcaaaagaaaataaaaaattacccaatttaacgctaaattatccagcacttgcaagtactttaaacaaatacggaatgcttttagattttagtagtcaaagagatttagatgaaaaaatcaagtccgaatatgatgataaatttcttgttgaaatgaaaaatctccccggaattagcgctgaaagaatcccgttattaccaattcttaaaacctcgaaagtgcttctagttgacaaaccagttttatcttatattcttgaatctgctaaaaaatcaagtcaaaatttcaaaattgctgaatccgatcagcaaaaagttaaagaactagatccccaaaaaaccgattatgaatatatttccaaaatttggggacaatatcaaaattttccccttgatcaaaatggttttgatggatatacttttagttttgaaaaacttaataatttcagtgatattgttgattttcttagtagggttaaaaaatcttttcccgatgcccctaaaggtccgctaactgaaaaagtcgattttcttattggttttaatgatgcagctgccctatttttatttgcagcttttgcagttgccgatggtaattataatcagtcaagttattttcgtgatgatgaaaaacagctactaaattataataatttatttaataaatcaaccaaaaattaccaaaatactaaaaaagcctacgaaattatggcaaaattaattaaggaaaaactagctggtccctgaaaaaaatcttatgccagcgattatcttaaaaatcaccagctagtttttgccctgacttcttcaagtcattatagtcgtaattttgaagaattaggtcaagtttttctccgttttagtaaagattctttccaatttgactatccagttggatcaaaatcaaaaatttgaaaactagtagatcaagaaaatcttcccaaaaatgcgattgccaaagtccaccaaattcttgataacaaacctggttatgtctatgttttagcacctaattctactagcgaaaatgatatcatccttgatccacaagttgatgcaaaattaattcaggaaataaaaaatactataaaaacaaagggcgaaattaataatttcagctttttaagttcagatcctgattttgaaaaatgacttttagaaaaaaaacagacaagttctgatcttgccagtctatatttggattttggccaagaaagtaaatataaactaataaaacaaagtaaaaatgtcactcttttttcaaagtcctatcagaaattaaatgaagatgaattaatgattctccctgaaccccaaaaagtcgaaaaatcaaataaattcaacattctcaccctccagggtccttcactgattggttttcataataacgaaaaagaagatgttgccacacttaattttgttaaatgatttatttcccaaaaagaggaatttctaacagaaaaccagcaaaaacttgaatcaacaccagcagattttctagcatttgccgcgggaaatttaaatccgacaaaagcgaatttaaattcggattttgaaaaaaatccactatttttgcaaaatccaatttttcaaattccgcttgcagaattcaaaaagcagttagaaaatccagaaaaataccgtcttttttcagaaccggccggagttgattcaaatacatttcgaaaaaccttattttcaactataacccaaattaataaccaatttttgcaagatcccgaattagatcttaattttgattatttccttgagcagttaagagcgaatattgccctatcagtgaaactggaaaaagatcaaaaaaattcgcaaaataaaacagttaaaaattaaaaattatggagaaaattataatgaagtatcttaagaaaaataagcagaaagttaaattatcctataaatttaggcgttttttcctaaccagcgcacttagttttgctcccttggctttagttgcaagttgtgttaataattcccgatttgattcaaatgaggataataaattagtttttggtcatactttttcatcttcaggaaaagaagcaaaagcacttgagaaaattattgaagtctggaataaaactgcaactaatcaaaaagattttatcaaaatggaagcacaatatttccagaatggctataatggatcagcggcttcgattacaaactttttacagacaaaagatcggataaaactgccaaatattgtcacaaattatccttcacttctggcaatagttaataaatattcaatgacttttccgcttgttaaagattttagttctaatcaagaaccacaagatgaaaatgaaaaagcaataaaaaagttcctaaaagagcaaggaatttctgatttccttgaaattaataaagaagttcctttccttgatacaaagggagtttatacccttccatttggaaaatcaactgaagttcttacaattaataaagttttgtttggttgaatgattaataaagcacttgctgatccaaaaaagccagcaaaaattaaagaagaagataaaccttattttgccgaatttcaaaaattagccaaggaaaaaactggtgatattaaggaaattgaaagaatctgaaaaaaatatgtctcagatgatcaaggacttgcaggctatgaatttcgccgatccgatcttgaaaattttactgacctacagaaattatcatcacgaattcttcgttcttttccagaggccctttcaggaggatccactgattcggcaaaatcagttttaggaattgataatcaagcaacgctagtttttgctcttgccagatcagtttcagaaggtaatcgatcacaggaagttaccgttcttgataggcaaaagaatttaattgattatatatcttttatagataaacctgattcaattagatataaaaatttagaaaaaatttttaatttattaagccaagggataaaagatcgctcaatttattatacatctgcaggggagtataattcaacttttttccggaatcatcagcaagttttctcaattggttcaacttcaggctatttccataattttgtcaaaccaacagcgacaaattatcaaatcggctttaacaaaaatgatggtcttaagtcagtttatagcgttagctatcccaaatttagcgcaattgtatcacttgaagatctcaaggatataaccaaagatctagaaataacagcaaccgatggtagctctaaattaaaaattgatgctaaatttttaggaaaactcaaagaatatgcacagcaaaatccagttaaaaaagtgttttattttactgatcgatcagaaaaaccttcaggtatcttcgaaaaagattatattgttttaggcaaatacaaaaatgataaaaatgaagaatttaatggccttgtaattccaacttatacagaactctataaaaattctggatcaaatgcccttaatgatgatgaacttgcacttgaagccccaccgcataaattcgatgcaaatagtaaaatcacccccattgtcgcccaaggtcctgatctaatttttattcattcaactgaaaaagaagataaagccgcaaaagcttttgttaaatgacttttgacagaaaaaatagtctttgaggaaaatagtcaggaaaaaatgactccgcttgagtattttgccagagcaacctcatatttattgccaataaaatcaacgcttgataaaacccattttagtccaaaaaatagatctcagaaattcatacttgaccaatttagtaaatttcttaatgctgattcaaaaggaaaatattcgcttgtctatgataatgccgatgcaaatgcttcatccttccgtgaatcactagattcttcagttgcccagatgcaatcattaaaagcaagtgatggaaaagtgcgtagttttaaagagtttttagaaaaactagagggaaatttaggtcctgcttttaaatcaaaataagcaaattatttagttttttaaaaattatgaaaaaatttataaaaaaattactttttagttcaagtgcaataattttgtcacctttattttttatttcttgttatcaaaatgaagcaactcgtttataccaagaagcccaaaaatactataaaatacgtgattttttaaaaaatccctttaatgatttatttgatcaacaaagtgattatgcaaaagatattgcaaaatttttagatcaaaattatcaatgaactcaacaagataaactaaaatttaaagatgataaattacctgatcaacaatattttgataaaatattagccgaaattgttgaatgaaaagatggagatactgtcatattaaaatcacttaattctgaaaaacttccgcaactttttagcgttcgacttgaaagtatcgatactcccgaaactggaatgattaacaaagatggtaaatacgaaaaaactagcggagttgaagcaaaattcgctaataaagcaactgaatttgccaaaaaaatactgcctgtaaaagcaaaagtttattttgtttttcataaaactggcccatcacgttcttatgagcgttatgttggtagcatttttttcggccatgatgaattttataaaaattattcccttgaaattgtcaaagctggtcttgcagctccaattctccatagtggatttagcgcaataaatgatccaacgacaatttattcatatctttcgatcaaacaagcatcagcgcttgagaatgcaattaataaaaaattcggcgtttttgagggaataagggataagaaatttaattcaattactcaagttcttgaagaaatatggaagacccgaggtctccccccgattagtaattttttagttttaggagataaaaataagaataaaaatgttgttgactggtatgaatttggtcgagaattaaaggaaaaaaaataaaaaacggaaaaaaatgaaaaaagataatgaaaatctagactaccaaaatgctgattttgaatatgaaattaaaaaaattcggcaggcggccgaaaatcgttataagtcaaaatctttgattccagcaattgaaatcaaagatctaaccattgattttggtgaaacacttgcagttgataaggctaatcttaaaatttttaaaggtgaacttgtcacccttttagggccttcagggtctggaaaaacaacgattttaaacgcaattgccgggcttttaaaacccacttcgggccagattatttttaatggggatgatgtaactagaaaatcacctcagcaaagaaaaattggacttgtttttcaaaattatgccctttatccgcatttaaatgtttttggaaacatcgctttttcacttcataatgacccaagatgaaaacaacgagcccttgaaaaatctatgcacgcccaggtaaatgctaattcgattgttttagcaaaaaatggcgcttcccttgaagaacttgaaaagtataaggcacttttatttgattattttaatgtttatcgccagttagagcatgactatagcgagcttaaaactgaaatgtatcttggcctaaaccagctcaaatcagattatattttaattgatgcccataaacaatcagaaattaaaaatctaacaattgattttctaaaactaggtagatcagcatcaattttttgagcaattttaaagaaaattttcaagaaaaatcaaagtgaaatctgcccaatccaacaggcaatttcttatcggaaagcttataaattaaagctaaaaaaaatcagagaaaaagcaaaggctgataaaaaggactataaaaaccgaattattcaggaaaaatatgcaattaaatatgcccctgaattagtcaaagcccgtaaaatttttcttgaagaaaaatcacaattatttgaaaaattagaaaatcttgaaaatttatataaaaaatttaaattaaatgcgaagttagaattaacaaaaatcaaaaaaggttataaaaaatttcgtactaaaacgaaactaaaagatgaagaatcactaaatcttgactatcaagaacaaattgaagccttcaattttcaaaaaaaagaaaaagaattatgatttaaaacccaaattcaaaccgaaaaagcattaattaaaaatgagaaaaaactcgaaaaactagagcaaaattacattgaaaacaagaaaaaatttctagaaaataacagagctgaatcaccaaacttattacttttaaaatcacttaaacaaaaaattaaaagttataaagcccaaactttaaaacggtttttagaatgagaaaaaaacctgattagtaaattttcccttaatatcgaaaaattatcagaagctgaactaaaagaatatcaggaatataaatcaaaaaatatttcgattaaggaagcaataaatcaggccgtacttcagacagccgaaaaagttgaaatcaccaaaaatctggctaaaaaaccgacaaaattatcaggaggtcagcaacaaagagttgcaatcgcccgtggaatcgtccgtcatcctgatattttattaatggatgagccactttcaaatttagatgcaaaactgcgagtccaaacaaggcaatgaattagaaaaatccagacagaaatcgggattacaactgtttttgttacccacgaccaagaagaggcaatgtcaatttcagatagaataatttgtatgtcaactggttatattcaacaaatcgggactccaactgagttatatcataaacctaaaaatgaatttgttgcttcttttttaggtgttccagaaatgaatatttttgatgctttctatgatcaaaaaagtaaacgcgttgttattgacaatcaagtaatttacgagaatttagaaaattatccctatgaaaaaatcagagccggaattcgcgctgagcatctaattgaagatgcaaatggcaatttttttggaaaaattgctgcaattgaatatctcggaaaagatatccaagggaaaattgaaattacaaatttaggtcttttttcgattattttaaagaaaaaaccaacctatgaaatcggcgaaattatccagtttagctttaaaaatggcaaattacatttatttgattatcaaacaagggaaaggatctaatgaattttatcagcggttttttttataaaaggcggattcgcaaatcgcgtttagaactagggattctcgatcaaaaacacccgttttgaaagccttttttggtgcttttaccttcaattttagtaatttttttatttacctttctgccttttctttattcaatttcaaaatctttaacaattgagatcaaccataatatcgccggaaatacccgttttggctttgataatttcattgatttgatcacaattgataaaaattttcattatgcaattagaaattcagttgtctattcaattctagcccttccttttggtctaattattagtttgataattgcatcagcaattgcttccttgcaccgaaaatatgcccgtggattttgacagacgattttttttatgccctatgtaacctcaggaattgcgatttcagttgcatttggttatatttttgatagtgaaactggttttattaacaaactttttggtatttcaactagatgactaaattcgggcaatcccggttcgctgcatgcactttttgtggtcttgatctcgggaatctgacgtagtcttgcttttgaagttctaatcctaacaaccgcaatgttatcagtaaatccaacactttataaggcagcagcaatcgatggcgcctcaccgattcgacagtttttcaaaatcactttacctacagtttcaaagacaataaattttttgatcacaattggaatcatcggcggaattaaggtatttccggtcggaattttcccaaatgagaccgaagcaattacaaatggaggatcaactttgcttgtctatatttataaaaatgtccgcggaacgcctaattttgcccaggcaggaacattagcaatctacctttttattttcggaattgccctttctataacagtaaaaaaatttttaaatgggatattttgaatatctaataaaatttcggagagatatgtttattctaagattaaaaattcgcaaattcattagcgatcgcaaaactgcaagagttattgaaaacattaattcccaggtcaaaaatgataatttaattagtgcaatttttaattttatctttaaatttatagtactttttgtttttggtatcttcattattttccctttttattttatgtttgtctatgctttagcccccgaagatcagattcttgatacccgggttccggttttttgacctaatcaatttacctgggataattttacaaaagctgctcagtctggttattttaaagcccttggaattactgcgagtgtatctttaattgccgttgttggaaaagtatttttttcaatgacttttggttatgcattttctttaagaaaatgacgatttaaacagttatcctgagccattttcttatcaattttagttcttcccgagacagctttaataattggccagtatcgaattatggtaatgcttggttgaaatgatgggtttcagtcaatttttgccctaacagccccatttattgcctcagttttctctggtctaatgttccgtcaagcctttgaagaaattcccgatcggatcaaggaagcctcaatggttgatggctgttcacgaattcgctacttttttaaagtcgcaattccaatggtaagtccaacaatttgaactgtcggaattctaacagcattagccgcctgaaatgcgacatcctgaccacttgtgattctccagtcaaattcggcaaatgttcaaactttaaatatctgattgctccaaaaagttggtgttgctgatgagacaatgcaagtaccaggaggatattttaaaaacatccggatggccggagcgcttttggcggttttgccaatgtttatcgtctattttgtttttagatcaagaattatgaaggcagtttcccgtcaagaatcaacagtgaaaggttaaattatgcttaattttaaaggatttttcaaaaaacagaagcaaaaaattaatcttttatttcagtcaggatttatttggttttcgatgattagcggccttgtttttaccggactaattatttgaggaattatttatttttttcaacaagcttttactgatggatttttataagcaaaaattattgaagaactttgttatatttttcctaatttaatatttctaaattaggaaaaataatattaaagaaattatttaaatattaaaaaagttgactaaatttagtcaactttttttaataaattaggaataaataatctgttttttaaattttttattccatatattcgctaaggaatttttcaaggatattattatatttttgattatcttttggtttatcaaagagggcaaaaccttttagtgttattccggttggttttctactatcatcttgttgttctttgtcaatattttcttgattgttgctttttgttgtacctaaagttagatttttagctagatcgagattttgaaattggctctcaattttggcttttcagctaaaaatttcctttttccctttttgataatcacttgaaaaaagcttcattttaaggtatttttctgcattttcgctttcaactgttgcaaccagaaccattgtagcagccggagcattgaggaaatcatgtgatttatctgattgatttttaggataaagcgcaactttattatgttgaagaagttgtaaaaggaaatcatgaacatcttgataagttccgttaaaagttttttgcagcccacctgaggcatcggtccattttaattgatttttattattttgctctaccttttcaaaatcagcaccaattttattaaacccggttagtaatatttctggttcgattaataaactgaattttgaactagaattatcacttgcgcttaatagaaaatatcttaaaagtgatcttcgtgataatttagtgggtttaaaggcataaaaaattgtcttaccctcatcaagtttaagattttttgattgttcttgacttgagttttcaagacttattccaccttcagctaaataaataccggcttgatctagatgtactttttgctgcgatttatttgaaggttctggatttaccttaaattttaaattcggattatttagtgcactaatcgatgcaagtactggtttattttgatatttttcggttgttgtagttatatttgatcgtcaatcaaggaataaatcggtatttgtactttggactaatgcttgataagctttattatcaggggcaactttgtcaattttgatctcaagtgtttcttttgttattccttcaacttttagttctaattttaaaataaatttatcccgataaaaagttgataaatataataaagtgtttgtcgggaaactagttttttctaaattttcaaaaagtttagataagtaagttccaccattttctgcctggattgttttagtttcaacttttggtacttgttcactttgatcagtttgttcactttgggaatctttacttgatttttcttcttttgcttgacctttttcctgactttcttgttgttttacctcttcattaaataaaactgcaccaactttttgcattttaccatttggtggagccatttttgtttctaatttttcatttttacttgttgaaaaattaagaaaatcaaataaaggactcatttttttagtaattcccttaagttcaaggggtttatttaaaagatgggcaatttttgtattaattgttgaggcgaaaaccgttactggaagatagcttttgacctcaagttttaaattatcaagattttttgccgttttagcatcaaataattcaagcgcatttcgaaaatatccagaataaatttcttgtgttgcatcgtagtcaaagtcgaaattataattatattgtttatcttgagtcaaatttagacctgcaggaacttgatcatttactaaaaaagttccttctaattttaaattaatagttaataaattcttattctgactaactttttcaggttttttaactaaaaaagctgcttttttggcctcaaaattaggaattaaacctttaatatcagcaaaaaaagttgtatttggcactgatttttgaataaatcaggactcaaatttagttaaatcaagactttttggattagaagacaatgaaaataattgtgcaatatctaagttatttttggctaggtattttgaaatttcactattaaattcatagtttttcaaaaaacttgctaaaaattttcccccatatttctgatttgtttttgggagatcaacaaatctaaggggaaaaattttctcagttttagctgttttatcatataaaaccatattaagaacaagctcatttttttcatcatttatacttgcaaaaactagtttattatcttttagatccggtttgatttcaaaattttctggaaggataaaaattggttcagaatttaggctaaaggaggccccaccaaattcgccaaaagtttcatataaggcaatttttgaatcagaaagtttattaaaccgttttagtcaagcattataaaataaaattgctatttcagttgcggtttttcctttaagtgattcaagatttctaagactaatttggccagtgaaattttcgggtagaaattggaaagccttttcttgacctgagaaatcaaggtcgaattttgcagtataatttatggtttttgaatgattagttacattaagtccgatattttttagcttattttctttgatttcaaacctggatttattatcagggataaccaatttaaaacttagatcaggatatttttgacttagactacttaaatcaactgcatcagctagatcgaaactataagatttatcaaagtgaaaatttagagcatcaaaagcgtttagtcgcttggcaaatttaggttttacctttaaatttgcaactaatttatcaaattcagcactattaaaattagttcttgaggtcaaattttgtgcttttccaagatcaatgttataagaatttagttctagattatatttttcggcttgggatgaaagtgcataaggaattgtaacagcaagacttataattgtactaattccaataattgagaaaattaaatattttagcttgttttttttcattttttctcctttttattttaaagcaaatagtgattctgaactttcaataataattaccctaactggcttacttgagtgaatctgtggctgatcttttttgtatacatataaatcaaaattatgtcgtatctgattgccaagttgagatattgtattagtaagaactccgggaatttcttcgctttgatgaatttcttgttgttctggtttagctgctactggcttggctgctgaaggttttgcagcaacttttgctgcttcaggtttactactttctaaatttttacttgtttttattatataaaaaccataatctgggtaattattttcaaaaaattgactaaaaggtagatttttgatctgattatcaattttaactggagtattttccgttttaattacttgttttatactatcaacaagttgggtataatcttcttttttaaggaaaataatttggtctgcacttggaaaattagtagcaatttcatttaatttttctacatcttcactaagcaatttattattttcattaactacaagatccaaagtttctttttttgtttggtaaatcacttgaattaaattcccattttgatcaactgaaccaattttatatcaatattttaatcttaaattattatttggattagttttttcctgactaactgctacatttaggcttataggttcgagttcaaactgaattttatagtctaaattttgcccgagtgattcagcaagaagtccttgatcttttgaataaataagcgaataaaaagcaactagaaattcactaagatttgtaattggatttttacctttttcttggataaaatcttttggtttaattgattttgcaagttctcttatatgttcgacaaaatctctcgtgttaaatgcgctttcagttttgattaagtccaaagtattttttaaatttgagtgaaggtaaaaactattattaagataatcaggggaaattaggtagtcattatttaatgaaaaaagtcaaaaatcggaggtcagtgaaactgcttttttctcaggaggctgaatttttatttgacttaaatgtttaaataaactattttggtcaagattttcaggccattgtgtttttggatcaattaatttaaatttatttaaaagatcatatcaatattttgcaacaaaactgatatccctttttgcaagtaaagataaaaatgtactaacctcttgatttgttttaaatgacttattccaaagattaataattccctcagacattttctcaggaactacacttaattttgcaaattcttcaacattaggtaattgtgaattatgaactaataattttaagcgatcttcgttaaattcatagccataataatcaccattttcaaggatattttttaatttatcaaatttattggcatttaagagtgcaagaatttctgattttggcgcacccttttggtttgcaattttttttctagtttctggtttaaattcaaattttgtctgtttaatttgctttactaattcagcatcattttgcccgagacggtttagatgttcaatagtttgggaaaagtttttttcagcgacaatttgattttcagcatttctaagaataatttttccgaaaattttggcaacaatttggttatttttaaaagccaatttagttgaattagcatctaatttaatatctaattttaaatattttaaaaattttgcataatcaataccggataatttattttcaaattcaacttttttcagaagcggagttctaacaatttttgctataaggttcttgagaaaatcttctctctcgttttgagttgcaaaaatttggttattgtaataatttagaaaatctcaaccattaatttcggcttctaaatttttttcaaaatttatttgtgggtaataatcatcttcagaaaattcagttattttaatattttcagcgactgttttatcaaggaaaaaattattaagatcaatgttaattccaaaatgaaactttgaacttttattgagatcagccgcaatttttttagcaaaattcggcgaaaaagcagcataaaatgttaatttataaattcctttttgacctgtttttgctaaaaaatcctgacctaaaatttgatctcttacaagttcaatctgatattgcggatttcatattccactttcatctagataagaaaattctttattattaagaatctcggcaataatttcttctaaattaaaatatttattaataattttgcgggcttcattattatttattgcccagtttacttgcttttcaaagtcttctaattttactaattttgtaagttcttttttggttgataaactaaattccttgttggtataagctcttagtttttccaattttgaacttgaaaaattagcgaaattagcaagtgaataatcagggagataatttcagataactttttgggttaaaagatcagaaattgcctttttatcatcaggtagttgatatactaaacgataataaatttcaaaagattgttcttgatcaagtggttttagatcaaaaacatcaagtttgtaacgatttcagccataatcagtggcaaaattaattggtaggctcgtgttatttttttggtaaaaatcaaaaaactggctatagtcaatcccagtttttttagtattatcagcattaaaaagctgttttttaagatcaaaatagcttaaatttccattttgatactcatcttttagttgaatatttgtaattaattttgcttgattttgtacttgaagtcgtggatctttgatctttcaattagcaacggtgacaagcggaattgtgattattgcaattccgaaaaaaactgcggccccaattgttaaaagattttttctagaaaggttagtgttttttttttttttttttttgtagtgcaagttggtgttttccataaattttttgatttccttaatttcttcaattaaaatcaatatctcttaaaaagaaagttttatacattaagaattataacatttttttcaaagactaagaaaaaaaaaaaaaaaaaaaaaaacctacaaaaattgtaggttctcaaaaattagagaaaaacctaagaaatttaggtttctaaatatttagaaaaatcaactttctcaagcagtgaaataatttcttccttgctttgggcgtttttaatcttttcaatatttgcaacatcttcaaaagcggcaacaatttgggggagtgctaccgatgtatgaatatctgaattggtagctgccagggtaattaaaatctgaactggacgactatcagcttcaaaataaaatggtttattaaaaacaacaagtgaaaagccattaccaaaaacgccttttccagcttctgcatgaggcatagctaaaaaaggggctaaaatataataaggcccattttcgattgttgattgaattatcgcatgaacatattcagtactaattagacctttatctaataatggttgacaagaaattttgactgcatcttgtcagtttgatgctgtctgatttataagaattgaatcattttccttaagacttgtaagtaaattaactgacatataaaaaaatccttgattttttggctaacttagttctttaagaaccggagttagcgcagattttatctcattttcatccattaaattagttacgccaacaatttttgctttttgtttttgactaaattcgctaacaagatgtttggaggcaataatgatatcaactgaattagtaagacctttggattggcccattgaaagcgcttcaactgtggcatctattcctaattctttgacaattttttgaactttcaacttgataatcattgaagttcccattccatttccacaagcagcaacaatttttaatgccataaatacctcttttaaattatttttaattaaaaataagatttgaaattaaaaaatctgaaatttgaatttagtttaattataccttatttttaaaaaaagttaaataaaaaagagaaaaaaagttataaatcttgcaaggatcaaaaatttttataaaaaaatattattctttataaaaatttttaatttattatcatttaatttcattttttaactttttttaaaaatcagtgtcaaagcaaaaataactaacttttaaaccggaattttaagctttttatgaaatgaaatcagctctaatattaatattaaaaaaagttttgatttttagtaaaatcaaaactttttgtttaaaattcctaattttttccttttttcgaaaaaaatttaaaaaatctttaatattaatgcaccagcaaaatttagacttctttattaattagatccacttcaacttttagtagtttttgtagtcaggttttttttgtttggttagtagaatcaaccgcttgacctaataaaataagaaggagaatcgcaacgatgatcgcaatccatccaacaacaaaatgaaactgtccaataattaaaacaagtccaaagaaaaggtttcaatcacccattcccaaaaatccggttgcaaccggattttggcctaatggaattccttcaccactaatattttgtactaatttaagcgcaaaggaaattattataatttcaaaaaatccaataattgctggaacaataaatgaagcttttcaaccaccagaagcattggcaaaaacacccatagccccagaattgaaaaagagggtaataaataagggaacagcaacaagggaaaaattatttcccgggattgccgcaagtccgattgtaacaaaaacagcaaggaattgaccaaaaaccccacctaaaaatccgtaagttacggcattaattgaaaatccataagttgcggcaatatcaacagcaactaccgctcccggaattattttctcggaaatcccatggaatgactgttgtaattcagtaacaaacattcttaccccggtcattaaggctactaaagttgctacaattttaagtactccacctaaaattaaaaagacaaagttagccccacctaaggaagaatttcaagctgctccaatttctttagctgcagttttagctgcagatgttgcgctttcaggagctgcaaagccgttaaatttcggattaattacattttcaattccgtgatagccaatgataattgcaaaaagtacggcaaataaaactaaaatgataattgtctgggtaaaaatattatcttcaaaaattttaagcgaactaggcaacttacgattttcagcactttgctcttttttcccaaaaaagcgaccgattttataacttgtaaataaactaagcatctgttgatgcccaactgcaaaaccagcattttgggtaactaaattagtaatttttagtgttgctcccgatgcagttgcccaataaattcctaaaaatagccctgaaattagcactagtccaacttgagatccagttgagatagccccatcatcaagaagcgggaatgtccggaataaaattacatataataaagcagttacaattgatgattgctggagcattacatgtcctgtaatcataattgagtttgtatttgtaaatctttttgctaaaaccattaaaatattaataataaaagcaaaaataaaggtaaaggagatcaatgtaagaaaatcattagcagccccaaaacctttttggagaaaattattagcggaagtccaaccaagataaggatctaagggcacaactcccccttctttaattcctccgattgcgttaaaaactggttttgctagcccaacaagtccgccggatccaaccgttaaaaggaaaactccaattgcagtttttagagcgccaagaattgcatcgacttttccacggccaagagcgagataaccaaataatacaagcgatcctaaaagcaaaggattttgccggagatagttatccaaataaactacccgcactaaaaagttaagggcacttgaaaaactttcttgatattttcccattctaaccccgagtgtgatcccgatgattaaaatgttaattaacaagaaaataagcaaaccaaaaagtaattttttattcttatttaaagacatttatatttcctttcgaaaatttagtctaaaaagatcgattaacgtataaaaaccagggttttttaacaaaaatttttgttaaaaaaacgaaattcttctagattttaaaggatttttttaattcaataatataatctggaagaattgatggatcaaattttcttggctgatcaaaggcaagaatttcagctggattattaacaagaatattattaattgtttccttgctaattccaacttgttctaaaagcggaataaaccgatcgaataaataggttagtccaaaagttcatttacctttaagttttccataatttcgctgatataaaacacgaccggcatcaagtgataaggtaatatgtttttctagtcctagatcgacaagatatttaatattttcagcaagagttgtatcaggaaaatacttaacccgatcaggaccatcaaaacataaagataccccaagttctttaattatttttgcataataatatttatcagggtttttattaagatgtgagatctgaattttccgtggatttgcaccaaaatcaattaaatattttgccgcttcataggccattgttcctaattgggtatgaaccaaaatcggtgccccggtttcaattgaggctcttgctgcaacctcaagtgattttaattcaagtcgatcaattgctccatatccagttccggctttaataattcctgctttggcttttgaacgtctaaccacaggacctgaataattatattcatccattccctgtgtaatttcagcaacaaccatttttacaatttcatctgttggtgcaagcgcaagtcatgatgcgcctttatcatagaaagccgctttatgaaatccagttgccataataatatgcacttttccttcaagagctttggcaatctctaacattcgatagacatcccgaccaacatttgggggatccattgtcactattgtttttccaccccgggaagcatattcaagtgattcagcaattgcagcctcatttgataacattacaaaatccggatgttcgtgagcttctggcccataatttttaattaaatgatcatgacagtcaacaacacctaattccgatgggtgaatatcaccgagaacagttcgtgaaaatttgtccattttttaaataaaatttatcctttcgttaattttgaatttaatttgaaaaattttttatttttttgttattttaaacattttaattataacattaaaattattttttataaaaataaaaagcaaaactaattttctagttttgcttgcaaaattaaaaaaaaattaggattttttaagtaaaaattttaattttgttcatcaattaatttcagaatttcctgcccggttttgatctggggattttcaaaccgggttgattcgattagcgaatcaagtatgatattagaaatttttgtagccttaaaatcaccattatcggtaagaatttctgatttttgaccgtttttattatcaagggcttttagcattgactccattgagatgattactgaacgcagatttgctgctttttcgtataaatttcagtcaatttttttggcatcttcgccgattagttcaaaactttttttattttttttctcaaaatctttaattgtggtataatattgattatattttgctttgatttcatcaagtttttctttggtgaccatcgtttttaacgggataaaataacccgtatttttcattaagtagtcggcattatcaattaatttcccgtcaatatcgttttttcctgtatataatcaggttaaaaatttctgcgttcccttatcaattttttcatttccagtttttataggaattaaagatgaaccgcctgaataataaattgaaacgggggagtcaggtagagcttttaaaggctgatttgtatggaaaatgtcattaaaagttgcaaattttttagccttttcgggcatatttttggcaaataagtttcttgaggttgctgaatccattgattgcttgattccaactccgggaatataaccaaaaaccgtgcgatattgtaaaagatcatgacttcctcactggccaattcccggcgctttaaaatttttaaactggaaagcttgaaggatttttgtctgatttttgacttttttggtcaattttttattacttttaacgtatttatcataggtttttataaattcttggcgcaaatttggatctgaattaattaaaaagtctaaatttttaccttttggactccagaaaggactacctgtttttgagatcagatccttatggaaaattatctgggaataatcaaggtcaaaaattgtagcattctcagttgcctcatcaagttgggcatcttctctaaatttgactccgttaataaatttagtggcaaattcaagagcattttcaatattttcaaaagtcgaaagatcaacttttaggtccttaaaaacatctggggctataatatcaattgccctgaataaactgttttttggggtagaattcccattattttcagcttcaactgctttttgatagagctcacttgatttatcaatactacctccgcctttttcgattagatcaaaaattatttttagattatcaaggttaaaaccaagagcatcaacatcatttttattaaaagggatattataaaacttattctgaccaaaatcagaactattataggcgctaacaagtttatcaacaaataaatcagggcctaatttttcgttcttgatttccaaaagtcggttatgttttgctaaaactgaggcagttgaaagatcgccaagaacaaggctaggaatctgatcggagtttgaatcaagtaaatttttgatattctgggtgagctgggactgtgtttttgcatttgattcattatcaagcacaagccgaactgggacaaaatcaggatcgtctttaaacgtcttattataataaggaattagtcctttttcattttttccatattcattgagcccaaaaattaaaggccaaaaaacaccctgacttgtgtttagtactacttgttctttctgactaccgcacccagcggcaattaggaaaaatgagggagataaaatagggaataattttaaatattttttgaaattcataagatttctcgctttttaatttttgtgaaattttttataaaaaaataagaaaaatttttattgttcttttaaaattttttgaatataataaattataaattagaaatgcaaaaattttgcaaaaaaaaggtaaaattttcattatggaaagtcaaaacagtgcgattaagattaaaaatttaattttctcttatgataaaaaagagtttttagaaatcaataatcttgagattccagctaaaaaaattactacaattttagggccttcagggtcaggaaaatcgacttttttaaatttattagcgggatttttaccttcaaaagcagcaattgaatatagcccggaatttgaacattttggctatataatgcagaaaaacaatctttatgaagaaataagtgttaaaaaaaacctatggattagtacaaagaactctttaaaatgaaggaaaaaagtctgattattaagtcttagggaatttgccaaaatcaaaaatttacctgattttggcaagaatttaacaaatttttttatagaaaaatcagattcattttgaaaaaaaattgcacaaaaagtaaatttttatatttttatcataaaaaatgtaaaattttattatttttatattaaattttgcaaaaaacaatttgaaattgaaattaaaaaaattttaaaaattctggaaattgaagatatttttgaaaaaaaagccgcaaaaatcagcggcggccaggaacaaagggtcgcttttgccaagtcaattataaaaggtgataatatggttttaatggatgaacctttttcctcccttgatacaaaaataaaagaggcaactatcaaattattacttaaaatcaaggatgaatttaaaatgacaatcattttagtaactcatgatcaaaatgatgcaatgaagattagtgataaaattatccttttaaataaaggcaaaattattcaattttcagtacctgaagaactttttgaaaatcctaattcattatttgctgcaaaatttatcggctctcccgagattaattttcttgaaaaaaccgcggaaaaaaatttttatataagaggaaaatatgttaaaattttgccatgcataactaaatcaaacggcaaaattttatataaaaaaaatcttgctgaaaattttttctaccaaatttatgatattgaaaaaaatactaatcttgaaattgtaactccgattgatattactgatcaaaaagttcaaattgagtatgatcaaagcaaaattcttgcctttgataaagagggtaatcgtgttcgggattaaaaaaaatactataaaaaccgttgtttttaacaaaaatacgcaggcaattttactaattagccctcttgtaatctttcttttaattttttctgtctatcctatttttcagtcattttttaatgctttcaaggttgaaaataatacaaattggcggcttggatttagtaatttttctagccttttttccaagtcagctttcagggacgctctaaaaaacagcacaattttattttttttaagttcgccaattgcgcttttttgtggatttgtaatcgcaattttgcttacaaaacttaaaaacaaaattgtgcgcagttttcttattagcggattttattcacaatttttcatctctgcttttgcaattggaattgcttttagtttcctttttggtgaaaaaaatgttttttctaaaattttaggccttaatttttcttttgttggcgaccaaaatcgtattagtttgatttgactttatctaatttttcaattatgaagggcgattccgtttaattcagttttgttttttttcgctttttcaacaattaatgcaaaatatgaaaaaaatttcaaaattgataaaattagcctaaaagataaaatttttaacctttattttaaagaaattagtacccaatttatggttatcgcctacacaaactttgtttttgcaacgatgttatacccgaatgtaataacggcaaatttgaacttggatctcaaccacgggcatacgctggcttcttatattttgaatgtgcgtgatgatttaggacttcaggcagcagcaagttttgtgagttttctataccttttagcaattttttctacttttttaatttttcggccaaaaatctgaaaaataatttataaaaaaataaaaacaaaaattaaaagaaaggttgaaaatgcacttaaaaattaattttaaaaactcttttattcaactttttcttatgtttttgttaatttttttattaatgatttttctatttccgctatattatttaattttaaatgcaagtttacctgatgaattacaggataatccgaatctttcattaaaattagatagctatttatgaactaattttcaaaattcaattaacgaaaatttctgaaaagcgctaaaaacttcaatttttgtaattttattaattaattttattagaattttactttattcacttgctagttttgggctttgaatggctaataaaaaaattaaattagtatttattagtctatttattgtaatttcttttattcccgaaattagcatttatatcccgctatcaaaaattcttaatgtcaattatctagttacaaatgcgccggttttttcgttaattactaaccaatttttttccttctttaactttttttacctatatagatcgattaaaaaaatagagaaaaaacaattttttctagcaaaaattgataaactttcaatttttgcaaagtttaaattaataattttcccaaaaattaaaatttcttattatttattaattattttcacaacaattcaagcctgaaatgattttctctggccaaattatattttttcaaaccgatcttttcagacaatttcgacatgatttcattattctggccaatcaagtttgggatttctgcaaaatattcaggctgcaggatcgctttttgcaatcctagtacctttatttttttatttaatttttgcaaaatttataaacaaagcgactgctaataatataaaataaactctagaaatgaaaaaaattatcacaaaaaatgcaacttttgaattcgaaatcaaaaaatcgaaatttatctcgctaagctttctacttaagcataagaaaaattttgaatttttacttaattctgtcaaaaatgagcataaaaacgctactcatatcgtgtatgcggtttgttttagtttggaaaattgtaaatttagtgatgcaaatgaaccgaaaggttcagccggaagacaaattttccagattttacagcgaaaaaaactaataaattcactaattatggtcatacgttatttaaatggtggcaaattagggcttggcctgctacaaaattcctacaaaaaggcggctcaagaagtaataaaattaagtaaaattgcagattttacctccttttatagctataaaattaatactaaaattaaaaattttaattttattttacaattaatcaagaaaaataattgtaaaataatcaaaaaacagttttcagaaacagttgaaattgaatttgaatgccaaaccaaattagataaaacctttggttttgattttttcgagataaaaaaataagaaaaatcaaaattttaatacaaaaaaactttcaaaaaacgtttttttgtattaaaatttaaggtaaattaaaaaaatagactaaaaactagcgatattaagagaaaaaatgattcaaattcgtaatgttacaaaaaaactaggcacaaaaataattcttgataatatcagtgttgatattccagctaataaattaacatttatttcgggccagtcgggggttggaaaaacaacgcttttgcatattatcgcgaggattgcctatgctgatagtggtcaaatttctttttttgataatgaacagaaactaataaaaaacccaaatgttgatattgtttttcaagattttaacctaattgataatatatcggcagttgataatgttaaaatcggcactaatattttaggttatagtttcaaacaagatgaatttgtcaaaaatgcaaattttttaaatttggattcaagtgtttttaaaactaaaatggaggatttatccggtggtgaaaaacaacggatttcaattcttcgatccctaaatcgtggatctgaatttatcctatttgatgaaccaacagcatcacttgataaggaaaatgagcaaattatttttgaaaaaattaaacaaatgtcgagaaatcatacaattgtggtaattagccataatattgaaatggtaaaaaaatatgctgaccaaattatttatttggataaaaatggtccaccaattactgaaattattgaaaataattctgatagagaacttgaaaataatgagattccaccaccaaaagtaaaaaaaatttcaaaaatttttcaaattaagaataaactacgaatttctccaatttttgtgattgctgatattagcaaaaaaataaccttaaccatattaattataattgcatttttagcagcaattttctcaattagttttgcttttcagttaaatcttggtactgaaaaagttagtcggcaacaaaaatataccctcgcacttgataaaaatttattagaaaaaaagtcaaaaactacctttaatttagatgaaattaaccaaatcgagcattttgagtcagtaaattcggtagttccaatttattcgattgccgatttaagtttttactatgaaaaccgaaaaacaggttttgattcaatcgagcaagtcaaaattaataaattttttaagaacagaatcgaaaatgatattgttaattttgagggaaaatttattgaaaatgctaatgaaattatcctttcaaatgcaacagctgaaaaattaaaaatcaaaaatccaatcggaaaaacaatttatttagcccagggaaaagttacagaaattgcagctgcaaaaaacaaaatggccctaaaaattgttggaattaatcacggaattaaaacctcggtaggcaaacttaatacaagctttaatcttattagttttccaacttttattgcaacagaaacaatcttagcactagaaaatttagtaattcagaataacaatttgcaaaaaaagctagaaaaacaacaacttttttcccaaattagttcttattaccctaatgaaaatcagcagaattccgcactcgtcccgtttaaaattcagttaaaaagtactaatgcacaaccagaaaatttaaaattaatcaccggaagaatagcaaaaaaagtcgatgaaatactaatatctacaagcgcggttgatttaaatgcaaaatataaattaaaagttggtgatgtaattgaatcaatttcaccccttgatcaaaaagttaatcttgttgttgttgggatttttgaatcaaaaatctcggaactatactatcataatcaagccaaagaattttataaccattatcaaccagaacaattagcggcttatcttgtcaaaacagaggaaaataacgggcttgatggtgaggctaaaagcgctaaattcgacctaaaaattattccaccctcaaatttgatcagagtaataacaagtcaatcacttgaaatcatcgcgattattaacaaggtaacttttgctgtttttatcatttttgtcatcattttaattgcttttattcttgtttatgcaaaaacaatttctgaatcaaaacagaaaatgattggaattctaaaggcgctcggcggctcaaccctgcttacacttttttatcacacacttaatattctgctaatttcgcttgttgttcttggtcttagttttttagtgatttttccatcgatggaatcaattcatacattagttgttggtaatgaattacctccagcttcaaaatatcatttatcactaattttactttcatcatgagctgggctttcaactgtttttatcctaatttatgttttaatgtcactgataacttataaaaaaacaacacaacaattgctacgctaaaataaaaaaatacttaaattcaaagtattttttttattttagaatctaatttaggaacttgtatcaatctattttaaaaattgtaaaaaaaattaactaactaattaattttgaattctttaaatgaccttcaagaacttctgtggtaacataaccctcaaaacggcgaacttgttttccgtttttataaaataaggatgtcggggttccttgaactaaattttcacgggcaaaattaggattttcgcggacattcatccgaattattactaagttttggttatcaaatttcttatttacttcatcaattgtattttcatataaaatgcatgcgccacaatttggttgatggaaaacgataactacatttggcgatgtgagaattttgttgttaatatcctcagttgagtggatgtcaaaaattggcatatttctccttttctatttaattttactacattttttgaatttttagaaaaaaatttaattaaaaatttagtaagattttgcaaacaaaacaaatttatttgttttttcgccactaaaaattgaatttcctgtctgtggtaaggcaaaaaatgaatttttgggaaggatgcagcgggcagtagctccggttttttcctgaatttcttgctctctttcgggagattcactaaaaggggcaattacaaatttattattttttattgcctgttcgaattcattaatagaatttacaaaaactgtattttcaagaagtcgaatttttgcttttttgaataaatcagcttgaatttgttcaagaattttacggcatttttcttttaacagatcaatattgaaaaaaaatttttggtggttatcacgtcgaactaagcaaatttgattatttttgacctcattagggccaatttcaatccgaattggtgcgccgtgaacctctgaattattaattttgtatccgatttgttgatccgtgtcatcaattttataagaaattttagcgttttttaaaatttttgcgattttctttgcaaaaattttaacttcttgattttttttagaaaaaaattcaagaatatcaacctgaattggagcaattttaggtgggaaaataagtccgttatcatcgctatgaaccattacaattgccccgattaggcgtgttgaaagtcctcaagaggtttggaaagggatttgacttttattttctttatttttatagaaaatttcaaaattttttgcaaaattttgacctaaaaagtgagcagtagcagattgtagggcgcgaaaattttgcatcattgcttcaactgtataagtatttacagcgccagcaaacttttcacgctcagttttttggcctgaaataaccggaatggccaaataattttctaaaaaatacttgtaaaatcgggctatttttttagcaaattggtcagcttcgaccttacttgcatggattgtgtgaccttcttgtcataaaaattctgtatttcgcaaaaacgggttagtagttttttctcagcgtaaaacttgacttcactggtttaatttaattggcaaaatgttattttttgcaatttctgccttaaaataatctgcaaaaagaagctcgcttgttggtcttatataaatattttcgactaaatttttacccccaactttggtaatggttagtaattcaggagcaaaaccttcaatgtgctttttttctttttcaataaaatcctgtggaattaacagagggaaataaacattttcaattttttgcttaacaaaataagcattaacaatttttacgatattttcccaaattttataacctaaaggtttaaaataaattgttcccttaattgggccataattcattaaatctgcctgagtaataacatctacatatcattttgcaaaattggctgttcttgatgttattttctcaggttttttcataaacttgtttttttataactttttgggtgtggtgaattaacatatggctgccccagttagattcgaactaacgaatgacggtaccaaaaaccgttgccttaccgcttggctatggggcaaaaatggtggggggtgagggattcgaacccccgaatccgaagaaagtgggttacagccacccgcatttggccgctctgcaaacccccccttaattagcgaatgcaaagtaattataacacatttttttaaattctcatttttttttttttttttttttcatttattactttttaaattaaacttttaacttaaaatttgactttggttttcttatttccttaatttaattttaaaaaaaggaaaaccaaagtaaaattagctaaatatattagcaaattatattataatttttatatttttatgataaaaatcatattaataaaggaaattttcaatgacagatccaaaaatcccgaatttattagaaatatacaaacaaaaattagatgaaatttcatcaaaagagctaaattcagaccaaaaaaatttagcaattcaaattttagaaaaatttgaaccaagtaaacttgaatatgtttttcagtttatttctcaacgaattaaaaccggttttcgctttgattctgcccctgaaagtgatacaaatactgttgctattttagaaaaagatgaaaatcttagttttaaattcaatgaaaataatcaaaatccaaataccttaattattggtgaaaattatgatggattaaaaaatttattagtaatcgagagagagggggagagggagagggagagggagaggaggctttgatataatctatatcgatccgccttataataccgaggcaagtaaaaatgatgggaattcaattgctaatgaaaaagaagatataaaagcaagtaaatttatctatcgtgataaattttcgcgtaatggttgactaaatttaatgaatgaacgactaaggctagcaaaggatcttctaaaagaagatggagttatatttgtttcaatagatgacaatgaacaagcttatttaaaagttttaatggatgaaatttttggggaagaaaatttcgttgctaatatcgtttgaaggaaatcatcaattggttctcataaagatataaaagatatcaaaactgtcaatgttgtaaatgaatacatagtaacctatgctaaaaagaaaactaaattaagatttgattatgtaagacattctcaagaaaagttagacaaagaatataagcttaaagatgataattttgaacaatatggttattatagattagaaagactagcatataaaggattggattatcaagcttctctagattatgagttagaagctcctgatggaactaaatttagaatttatcaaaatattaaaaaaccacaaacaatgtgttatatatgatccaaagaactatttgactatgcgaattctttaaatttagtagaaatcaaaaaaactcaacaaggcaactgagttgcttataaaaaagtttatcaatatgctaaattcgatgcaagaactaaacaatttatcttagttgaaaaaggcgttccttttactaatatgattattgctaatcaaaacaatctacatttgaatattttgactgaacaaggttctaaagaaatgacaagcattttcaaagataaaatgtttgactatccaaaaccagttgaattagtaaagtatttaattaaaatggcatctagcaaaaaagacattagaatccttgatttctttgctggttctggaactactgcacaagccgttttagaactcaacaaagaagatggtggaagacgttcttttgttttagtaactaataatgaaaataatattggtcaaaacgtgacatatgaaagactttatagaattaataaaggacaaggcacaaaaggtcaaaaagactttgaatgaatcaagaaaaatgaagcctttgatacaaatttaaatgtattttgatctaaaacttacaatacctctttgttaaataacgatataacaaatcaagaattaaaagataaatttaaaaaactattaaaagaatttggaatccataaaaataaatcaaaagttaaagattctgtattaaaaactctttcttctttaagaccatataaagaagaaaattaaaaaaaataatttatttgctacaatctttataaattatttataaggagaaaaaatgaacaaaaaaaaagaacttttgaaagatcatttaaaggagttagaacaaatttctaaatcatctttaaatgaaaatcaaaaagaattaattaaattaaacttagaaattttaaaaaataatgacaaaatttctatagatgactttgaacaaatttgaagatttttaaaacaaagagtagcaactggttttgtttttgatgaagctccagaaattaataatcaaagcatcgcaatacttgaaaaagatgaaaaattatctttttcttcttcaaaaatgaaggataatttacaaaattctttaatcattggagaaaattatgatgttttaaagaaccttataggagtagagagagagagagagagagaggattctaacttcgatttaatctacattgaccctccttataatacacaaaagacatcagatgatggaaataatttaactgatgatcaaataactgctgacaagtttatatatcgggataaattttcaagaactggttgactaaatttattaaatgaaagattaaaattagcaagacaacttttaaaagaagatggagttatatttgtttcaatagatgacaatgaacaagcttatttaaaagttttaatggatgaaatttttggggaagaaaattttgttgcgaatatggtttgaaggaagtcagcgcaaggtacacataaagatgttgaagttgataatttaaacactgtaaatgaatacatagtaacatatgctaaagataaatcaaaatttaaatttgattatgtaaaacattcacaagaaaaattggatgaaatatataaatttagagataaaaattttgaaaaatatggtgcatataaattgcaaccacttgttaatagttgaaacggtgcctgatacagatctggacaagattatgaattagaagctcctgatggtactaattttaaaatatgacaaaatatcgataagccacaaagtgcatcttattcttgatctaaacctacctttgataaagctaaaaatttgggtttaattgaattcaagaaaaataaacaagattattgagtagttcataaaaaagaatatcaatatgctaaatttgatacaaaagaaggtgttttaaaaactgtagcaagaggtgttccttttacaaatatgattgttgcaaatcaaaataacttagagagtgatatttatacatctgaaggtgctagagaacttaattccatctttaatagtaaagaattcgactatccaaaaccagttagattaataaaatatttaataaaaatgttatctagcaaaaaaaacattagagtcctcgatttctttgccggttcaggaacaacgggacaagcagttttagaacttaacaaagaagataacggaactagaacatttacattagtaactaataacgaaaataatattggtcaaaacgtgacatatgaaagactttatagaattaataaaggacaaggcacaaaaggtcaaaaagactttgaatgaatcaagaaaaatgaagcctttgatacaagtttaaatgtattttgatctaaaacttacaacacatctttgttaaataacgatataacaaatcaagaattaaaagataaatttaaaaaactattaaaagaatttggaatctataaaaataaatcaaaagttaatgattcagtattaaaaactctttcttctttaagatcatataaagaagaaaatgaagaaaaataaagtaaaaaaggaaaataatggaacttagtgaaaaacaatctcaagctgttgatttattagttgctaaatgagataatgcctttaataatcaacaaaaagcctctgttacttttaaagcaccaacaggttcaggcaaaacatttattattgcaaactttattgataggataatggaagaatttgataaaaactcagctaaaaaactggtttttatttacaatacaatttctaatgctgaattacctaaacaaactttagataaatttgaacaatataaattttatttaaattcaatgaaaaatgcaaccataaaatataaagaatccccttcaaaacaaaaagaagctaaaggcgatcaagaatataatattttagctaaagaagctgatgttttcatttttggaacttcttcatttggcaagtcaactatctttgtaaaagaaggaaaattagatgcttttattgatgaattaagatcagattactatgttatttacattagagatgaagcacatattggtacatcaaaaataagtgaaaaagcagatgcaaaatcatttgataaaaaaataaaagaactagacaacgtttttgaattaatgatgacagctacacccaaagaaaatgatgatatcgttgaaataacaaataaagatttagatgaagacaactgaaaacttctaaaagctaacaaaaaaattaatttaagcatccctcatgaatctacagatgaaatagataattcatttctattagaacaagcttgtaaaactttttctaatattaaaaaacaatacaaacaaattagtgatgatgaaaatttaagaaatttatgaaaagtaaatcctgcaatgcttattcaagtaaaagataaaattcttgaaaaagaagctgaatttaataaagaaataaagcaaattattaaagttttggaaaaatataatttaagttatgctaaatatttttcagaagaaaaaacaaaaaccgttgctggtcacacttcaaaaacagacttaaattctttgtctaaaaaagatagtgatgttgatgtaataatttttaaagttggacctgcaactggttgagatattcctagagcttgtatgttagttcagttaagaaatgtttcttcagaaacgcttgataaacaaacacttggaagaattaagcgttttcctattccaataaaaatttacaatgaagatcacagaaaagaattaaataattcaatagctaatgagttttttgtttattcaaacagtaaaaagtttgatcaaaatttaggtgaaagaatctattatttaaaagatcaatacaaaaacaaaaaatttgttgttggagaaattgataaatctagcataattaaaataaatcaaacttacaaagaaaaagtttatgaattagtgtctaatgaatttgaacaaatttgtgaaaaattcgagaagtttaggaagaaaaatcaagactttttaaggattactagaaaaaataatatcaatgaaggaagatttattgaaaaactaattttcgatcaaattgagcttgaaattttcaatgaatcattgataaaaaaacacaacaatctaataactaacgatatgtgggacaatattgaattaatttataatcagaaaattaatgaaaatattagaatttcaattaattattataaatattacatcttgactgaattactagatgatattaaagaactaaatgtaaaaaattgagaaaatactaatcctaatttaaatatcaaacacattattgctccaccagaagaatatattgaagaatatgaaataattgatattaatgattcaaaagattctttaaaaaattatatagaaataaaaagtgaaatcgaaaaatatgcctattcaaataataaaaaaatagaaaaaaatcaagtaaaaatttctgtagattcaaaaccagaaagagattttgttgctttttttactagttgattagaagatgatgctgatgaaaatttggaaattaatatttgatttagaaattttaaaaataattcaaaaagtatattttgagattactttgaacaaacacaagtaaaaaaatcttatcctgattttattgtttgcatcaatcaacaccaaattaatatagaaattaaaggtaaaggtaataacgacataagccctgaaaaaacaaaagatttaattcaaatgacacaaaaatacgtaaaaaaagcaaaagaaaattctttaaaaaataagcaaaaaaataacttgaattttacttcattaatttgttgacctaaaaatgaaagagctgataatttcttatgtaaaggtgcttcaacattagaaaaaataaatgatttatttagaccacaatcttatttaataaccgaaagaaaagatgcacaagaatatgacattaaagaagaacatcttaaaaagatttttcgaaaattagcaaactaattgctttaaaaaaactacattttgagcagatccgcttttcttagaaaaatagaaaaggggatctgctcaaattaatagtatttttatttttataatctacaaattaaatatcacaatagactgaatataataaaataattaactttttgcttggggttatatatatatatatatatatatatatatataatatttaattatgaatttaaatacatattttaatccaataaatttaacagcaaaaaaattaaaagatattataacggcttattgaattacattatttttacccttaattggtgtagtgtttataataatagcggcagtagtagctcataaagccgtcgaatccgcttactatgctgattcattatctgagaaaagctttgcaatttttgctggaacagcaggaattatgattattattggaatcttaattgttgcaggaactggtatagcaaattttgtgattctcattattatgcttgtaagaatttttgctcttaaaaatttattagctccatatcaattcgcacaacaaaaccaaatgattttgtattatttgatgcatataataaattaaaattttcaggtcttatggggatattaattttttttctatcttgaacaatagttattccgattatgtgaataatagggatttttaaagccaaatctgctgctaatgcagttataatacatttaatgaatagtttaaataattaaaatttacacatcattttcaaataaataaaatactattagttttgaggtgataccctcttcttgaaaaaaatttttgagtgttttaattaattataatttgaaatgaatgtttccctaaatttaataggagacattcattttattttgtctttaattcgtttgtgattgtaataataaatataatttgcaattgctttgtaaagttgtttaaaagttaaaaattctttttcgcgaccataaaaacattctctttttaatgtcccaaaaaacaattcaataacgctattatctaaacaatttccttttcgagacatagactgaattattcctttttgttttaatttttctgaaaattgtctatgttgatattgttaaccttgatcactgtgaaaaattaaaccttcaagatttttgtgctttgaaaatgctctttgaagcatttttctaatttgttggttgttagcgcttatagacaaatctcaagcaataacttcgccattaaacatatctaaaattggtgataaatatgctttttccaaatggtccgctaaattcagttacatttgtagttcatttttgatttggtttatttgcaacaaaatttctatttaaaatattgtctgcgattttgccaacagttcctttgtaagatttgtattttcttcttggacaaattgctttgagattgaatttttccattaatctgcgaacttttttaagtccaattttatagcctctattattaaattcagcttttattcttctttttccatatcttgctttattttcttcaaaaataagctttacttggcttataatttcttcatttttcttgtcaaaatcttcttttttgagttcataataaaaagtagatataggagaaaactcttttaatacttgagttaagcgaaggtttttatcagcttttactttattataaattttttttattttttcttgccttggttgatttgagtcaaagatctctaccaaggcttttcacttttttagtgcttcgatttccttttttaaaagtttaatttctttttctaagtttttttctctttttttaaagtggttatttttttcttcaagaagtttgagtttttccaatactgatattgaagaatttaattgatctttactgtcaaaattttttgatacttttgtagatttattattactaatcttagatttcattattggtcttcctttgtttaattctaaaccaataattcccgattctaaatattttttcgttcaaaaagatatttgacttggattaagattattttcaagtgaaattttaacaattggttcattagctaaaaatcttttaacaacacttaatctttcgtctatagtccattctttatttcgtggtttttttcttaagaccttcaactcctaatttgtcataaattttttctcaaaaatttacttgatttaaaaattttttttgacttgtattagcgaaatcaggctttttaatttcaattccttttttgtatttttttacacattctaatttaaattctaatgaatatttcataaaaaatccccttttctatttttctaagaaaaggggatctgctcaaaatataagttatttaatttgtatacatttgaagactttttaaaaacagaaactataaaatagttgttaaaaacgaatattttgttaaaattaatatataacagatatttattgattcctatgtgggttttaagcgtaatattaagtgcgccaacttatctggctcctttatttgaaggagtttttttatattacttttgcttgctttttttttgtttaatttagatatggaaaaacaagttcaaaaaatatttatttatttagatgaatcttctagaatcgacttgtcatctagtaaacttcgtaataatgtatttaattttggtggattttattgtttaaatgaagaaaattgtaaaaacattttaaataaagcaacttctaaagaaatttggataaaaacaaagcaagaaggtaaagaaattaaaggtaaatctttacatttaaaaataaaaaaagaattaattacttttaaacatgcaataggaattgttgcatttttaaaaattttagacaagaagttttttaactcaagcgataaaaattattttaaattttatatgataagttatttaataaatagcattatagtaaaattaaaatatgaattacgacatcctattcaaatacatttatatttggatcgaaatacagaagttgaaaaagaagatacttgaaaagaaagtttaaaatctcaaatttgaaaaggattgaaatctaaaatagattatttgactgatgaagtgaaaaaactatatactcttgattatgaacctgatatttttattgaaagtatagattcaaaaatggatgacaacatccaattagcagatgttattgcaaatacattatatcaaacttataatgacttgaatctttcatgaatggatttttgttatactaatttttttaatattaaatttattggcgataaaccaagggtaccaaaacttatgaattttcaaaaacttattcataatcagttatttgaagaattttgaaattgtattgagtatttagataacaaaaaagagtagactcctgagatgataccctcttcttgaaaaaaatttttgagtgttttaattaattataatttgaaatgaatgtttccctaaatttaataggagacattcattttattttgtctttaattcgtttgtgattgtaataataaatataatttgcaattgctttgtaaagttgtttaaaagttaaaaattctttttcgcgaccataaaaacattctctttttaatgtcccaaaaaacaattcaataacgctattatctaaacaatttccttttcgagacatagactgaattattcctttttgttttaatttttctgaaaattgtctatgttgatattgttaaccttgatcactgtgaaaaattaaaccttcaagatttttgtgctttgaaaatgctctttgaagcatttttctaatttgttggttgttagcgcttgtagacaaatctcaagcaataacttcgccattaaacatatctaaaattggtgataaatatgctttttccaaatggtccgctaaattcagttacatttgtagttcatttttgatttggtttatttgcaacaaaatttctatttaaaatattgtctgcgattttgccaacagttcctttgtaagatttgtattttcttctagaacaaattgctttgagattgaatttttccattaatctgcgaacttttttaagtccaattttatagcctctattattaagttcagcttttattcttctttttccatatctagctttattttcttcaaaaataagctttacttggcttataatttcttcatttttcttgtcaaaatcttcttttttgagttcataataaaaagtagatataggaatagaaaactcttttaatacttgagttaagcgaaggtttttatcagcttttactctattataaattttttttattttttcttgccttggttgatttgagtcaaagatctttaccaatggcttttcacttttttagtacttcattttccttttttaaaagtttaagttcttctctaagaagtttaagttcttcatatacagataatgaagaatttgattgatcttgactgtcggaattgtttgatacttttgtagatttattattactaatcttagatttcattatcgatctccctctgtttaattctaaaccactaattcccgattctaaatattttttcgttcaaaaagatattagacttggattaagattattttgaagtgaaattttaacaattggttcattagctaaaaatcttttaacaacacttaatctttcgtctatagtccattctttatttcgtggtttttttcttaagaccttcaactcctaatttgtcataaattttttctcaaaaatttacttgatttaaaaattttttttgacttgtattagcaaaatcaggctttttaatttcaattccttttttgtatttttttacacattctaatttaaattctaatgaatatttcataaaaaatcccttttcttaaaaaaagaaaaggggatcacctcatttttgaaggattttttttattaaaacttacgatttgcagttgtatttaatcagttgtaaatacttaataatacttttaaaaattaaataatttttttatattttccctaaatctttcattactttttctatatcagtttcttgaaataatgtaatttgctcttcttttttaatggcaataacactgatttgagctcctttgttattttcgattctaggaattaaattattgctattgctatttacaaaatataattttttagatttttcaaaatctaaatatcactgacccatattagaagaataaaggttaaaaaagcttaaattaagtttttctactgctaaatataaattatattttgacaatatattttcaatgctttgattttcaaagaatttatttatatatttttctaatactggctttaagacattagaatctagtttattaaatttatttacatttgttaatgtaaaagttttaaatttattctgagcaaaaaaattatcaaatttttgttcattttcttttattgaattgttgtttatagttgaatcagcaacaaattcttttacatttgaatttaatttatcactactttttaaagtgtctttaaaaattcaatatgaattcataaaatattttttttgatattctgcaaagttgtcttcgctttttttaagaaagaaattattaaaataattttttaaaaatgattgttgataagttttggtttttaataaatttaaatctattttatatttttgctcttgcggaatacgatttcacaagaataaagctacactactcatcgaaattgtaaatattatcaaataagatcataaaactaacagtgagattttgataggttttgttattttagttcttttttcttggctaatatcattagcaaatcaagaaaactttaattttcatttgtttttttgtctcaaggtagccccttccattcttgtaaaagagtttttcaatctgtttcattattaaaggcaatattgtcttcttttttaaaggctattatacttatagttgcaccattattggtatcgcttgattcttgcggtcatggataataatttacaaaatataattttttatctttaagaaaatctagattccatcaacccattctagaagagcttaatgtgaaattcgagaaagagctattctttacaaaataatataagttatatgtttgtagtacttgctctacactttgattaggaaaaaattttgttaaatatttttcaaatacaggttttacaatgttcgaatctaaattatcaaactctgtttttaaagttaatgtacgagggatttctttatttttgttaaaaaaatctgaatatttatctatgttttcttgaattttatttttttcttcatctgtattggattctgttttttggatgtgagaatcaagttggtcactactttctaaagtatcttgattaactcaataagtactcatgaaatattctttttgatatttattaaaattattttgaatttttttaaatataaattcattaaatgaattttttaaatagattaactgtttttcttcttcatctgatagattaacatagttgggttgatcaagtttataatataaacttaaataataaatggaaacagcagatatagaaacagaaataattgttgataaaagtaataaaattttcttcgttttagacatattttaatcctttcttacagtgtacaaattttttaatttattgaaaaaatatatttaaattagcattttccttcatttttgaagcaaattagtaaatctagaattgtaatatttcaaacaaattgacttactactaaatttattttttaaatttttaattctagctaatttagaaaatacgaaattatatttaaatcaatttcataatggtatctatgttgctactttcaaaaaattctatattttcagattttttaaaagcaacaatattaatttgtgcgcctgtatatggaaccatagtatgaactatgggacgttgtggaggctctataaaatatagcttattgaattttaatgaatcaaatcatcatcaacctaaatctgtttttgaaagaccaaatgaatatatttcactttcttttacaaaataatataaattatattgatcaaaaatttgttctatattttgattaggaaaaaatttacttaaataatttttaaaaataggttttaaaatatttgaatctaaattttcaaattcttctttggtttttagtgtgtaattagtagctttatttgttttaaaataattatcaaatttttgttgattttcatttcgaattctttgttcattttcacttaaatttgatttaaagtaaaattcggatggaaatggttgctcaactttgtctaaatatttcagtgtttctctatgaagtcaatatgaattcataaaatattttctttgatattcttcaaaattatcattaattttttttactacattattatcaaaaaaattatctttttcttggtttaaaaactctttatttttgcatgctaaagtaaacaatcctattgttggaattaagacaacacttgataaaattttgcgaatttgtaaagatattttcctctttttattcatattagttttccttaaatacagtatgtgtcactgcaatagaatcatctactgaattttcaaataaagaacttttgtattttttaactatatatctataaattccagaatcttgaactttaaatttaattaattctacattactgttgatacttaatgatgaacttacactttgtcaatatcctctactatctaatttttctaatactaaatcatagtcagtgaataaagcttgattttgacgttttttagtttcttcaagtttcaatctattttcgtttatatgtttactttttcaatcgcttagttttagttcataatcaattccctgagcagtttgttttgcaagtgctcatgttggaaataatcattctcatcaatttggatgttgtaattctggtttattctcgttttcttttagcaatcctgagttaaacattcaactaagtgctatatttatttgttctccagcttgtaaatttaaatgtgagctttcaaatataccgccatccacatcggatttaataacagatttagtattaatatttcagctgcttcttgcattttttcaacatctattaaacctgctccataagttgaatcaaaaccatttccttttttatttaaatttttgtatttaggtaaatgtgcagaggcagctagaatagacattgcagatggtactctaaattgatcattatttaatcaagaaaatttatcaaaaatatatgaaatagcaccagtaactacaggagcagcaaaactagtacctctgatttcatcattattctctaagagtatctcccctggtgcaacaactaaaggtttaggtaagtttaaatggttagactctagttctctgttagaaaagttcgaaatttcaatgtcatttaaaaaagagttttctctatattttgttgatccgacagaaattgcgttatatgctaattgagtgctgtcatttcccttttttattttgtttgttatgaccatttccagcagcgaaaacattaactacaccatattttcttgaaatataatctatgaaaaaactatcatcatcataagggagagagtaatcagcagttggtccatagctatggttaataaactttacattattttttaaaaccaatcattcaagagcgttttgtcaattaaagttattagaactaaaacttgtgaaataaatttgtccatttgaatttattccgtttttacctgctgcaaccattgatacattagtcccatgtgtatcatttaaattttctggagtaaataatttaacttcaggtgtatgtacaaatttataatttctttgtaattgagttgtacctacttctaaaattcctatttttgaaccttttctgtgatatttaaaaaattctgtttgcttttcaggatttaaatttatttcttttaaaagtagttttttattaatgtctgaaaatctagaaatataatagccattctgttcattttgggaaactacatcattatttttgataataacttttttataaaaaacaattctttttacaaaatctaatgtatcaacatatttgataaattctttagatttttctacatcattaaagtaaaatcaaacaataggtagcattgcactagtttgaatttttcaatttatgtttttgtttttaaagcctctttttattttatttagaagagaatctattctttcatctaaatttcctttttcattaaaaacatctaaatatagttttaattcaattgtatcagataccttgtctgataatttttttccatcagtagatttggaagttggaattttccaatcattaacaacaaattttttacttgcaaaatttattgttgctaatttttcattattaattaagtttttattttgattaaatgaaaaaataggtacaaaaactaacgaagttattgtacctatcgcaaatgaaaattgaaaaaatttttttactttaagcatataattctccaatttttgaatttttattaagaaaaaaaatatataaagaaaattaaattttgaaataaatattcaaattattttaaaccaaatgtatatggattttttccttattttgtcttcttttttagatttgtttatgttatttttttaatttttgttttgattatatcatttttttaaaatatttaattaaatttaaaaaaataaataagataaataatttttaagtgttattattctttgaatttagattagtaaagttttttcataaaaaataaaatcacacatttttttaaaaatttagcaaaaaaatttagtttttttttttttttttttttttttttttttagctttatcaaatttaacttttaaattcaaattaaacaaatatattaatagttaatttaataaaatatattataatgtttaaaataaaaattgtatttacaaaggaaattttcaatgacagattcaaaaatcccaaatttattagaaatctacaaacaaaaattagatgaaatttcatcaaaagaactaaattctgaccaaaaaaaattagcctatgaaattcttgaaaaattcccggataataaacttgaatatgtttttcagtttatttctcaacgaattaaaaccggttttcgctttgattctgcccctgaaagtgatacaaatactgttgctattttagaaaaagatgaaaatcttagttttaaattcaatgaaaataatcaaaatccaaataccttaattattggtgaaaattatgatggattaaaaaatttattagtaatcgagagagagagagagagagagagagagagagagagagagagagagaggcggctttgatataatttatatcgatccgccttataatactgaggcaactaaaaatgatgggaattcaattgctaatgaaaaagatgatataaaagcaagtaaatttatttatcgtgataaattttcgcgtaatggttgactaaatttaatgaatgaaagattaaaattagcaaaggaccttctaaaagatgatggaataatttttgtttcaatcgatgatgccgaacaggcttatttaaaagttttaatggatgaaattttcggggaagaaaattttgttgctaattttccatttatttcaaatttatcaggtcgccaagtaaatacaaatttggccctttgccatgaatatttattgctctataaaaaaaataatttcatatttaataaaattgataaagattatgccaataactttatgcctattgtttatcccgagagatctaatgtgattttcaatgaagaccctgatgtaaataaggaaatttatgataatagcccagaacaaaaagaagataactccactcaatacattttgagagataatttagaaaattcaaatggtgagtttaaccctaaaactcgtcctaatttatttttcccaatttacgcgcggaaaattaatgagaaaaataaattatgagatattacggtggaagagcctgattcaaaacatgattttattgaaatttgacctcgtaaaaatagcaaaaatattcaattagtttggcgttgaggtaagaagaaaataatgaaccaaattaatgatcttgttattgtggagccaagggataaaaatgataaaaattatagaataaaagtaaaaatatttgatcaatcctacaccgttaaatcatttattttaggtaaaaaattcaataataagtccgctactaaagaattaaacaagatatttagcgaatcttcggaaaaggttttcaattttcctaaacccactgcgttaatagaatatctaattaatttacaccccaataaaaatgcaagagttcttgatttttttgccggaagtgggacaactggtcaggcagttttagaactaaatttccaagatggaggcactcgcagttttactctgataactaataatcaaaataaaattgccgaaaatgtaacttatgaaagactttttcgaataaatcacggttttggaacaaaaaaagagcaaaattttgactggattaagaaaaatcaaccttataaaactaatttagatgtttttcgaattaattattttaatacagaaatttttaacaaggaaaatgatgttaatttattagttaaaaaactagaaaaaatgttaactaattttggaatttctagcaaaaataagataaatctaattgaatatcttaactatctccttgcgcttttgcctcaaaaaaaggataaaaaataatgtatttagatagatgtccaaaaaaacgttgttaaaaaattatttaaaaaagcgcgtaattctcttagtaaagaaaaaaagaagcaatttattttaaagccccaactggttctggaaaaacttttatgatgatcaatttcattgattatttaattacttgaagtaaatctcaagataagcttaaacttgtttttgttattgctaccttatcaagtgctaatctccctgggcaaatccaggaaagttttctaaaatataaaaattatattaataataaaaatctaaaaattcatcgtatttaaagtccttcaaatcaaagacaagtacaaaaatcgaaaaaaattataaattttatgcagaagtccataatgtttatattatcggctcggcttcatttcggaaaaattcaattcttcgccaagaagaagcaattgaatcatttttggtcgagatcaaatctaaaaattataaattagtatatatccgcgatgagactcatatcggaggcgatctaaaaatcagaactaataaagatgatcctttttttgaagaaaaaatgcaaaatagtgctaattttgtctttaaaatgacagcaaaccctgatcaaaaacataatctaatcgaattaagtgaaaaagaactaaatggcgataaaataaaactgctaaaaacaaaaaaatactataatttagggcttaagtcaaatttagaatatgataatgaaataattcttaatgccacttgtaatttatcttgagattaaaacttataaaaatgataatgatgagcaaaaaaccgaaaaattatatgaaaactataacgaatatattaaaacaaattccgatagcaatattaaattaacaatggtcacatgttttgttgatattcacaaaaatgttcgagaaaaagcgctatatttttccggggcctgatcaatttacaagttaaactcaaaactaaatgacataaatccaaaccagaaagatcttcatgatataataaaaagtaattctattctaagtttatttgaagcttttaagttattaatcaaaatgaaggaaaatgcccatatttttttaaaaaatatgggaatttttgcaaaaaacattaatttttttgcaaaaatttaaaaaacaggaaatataaaactaagaaaaactagtaatattttttcatatcattactaacagaattaaaaacaaaaccaactagcttatcttgttcttcaattggtaaatttggattagtttttattacattatatgcataaataaaggcaggatggagcgagttactaagtggtcgcccaatttgatatagattacaccattttgcatttaattttttgcgtaaggtttcatcaacaacttttattcggtattccttgactaaattaagataagaaaaaattttaaaaattccaaatgtgagtcaaaaatttttaacgcattccgatcatttaatcggtataaaaaaacaaattccaaagaaataactcaatgtaggaaatcaagaaatataatatagaatttcgatataattattagttatctttaaaatattttcgtttatgataaaaaatattaatttatcggtaaaaagtgggcttaataaaaaaattagtcttactaaatagttggttaataaaaaagacgagtctaaaatataataaaatataattttttggcttttttgccgatttttggaattattaaaataaattagaacttgaataatcatcaaaaaggcgataaaagaactaacaaatacgatatatggtcaaaaaataaaattaccaaaaccagcaaaaattaatcaaaagattaacatcaaaaatgagacaaaaaaggttataattgtataatagaccgattttgccgtaaaagaaatattttttcaaagcttttcaaggggatttagctttttttctagagttttttcatgtttttgaaaaatttcaaaatttagttgataaaaactattgatccagcttgtatgttgttcgcgataattcatttttgcgtttagatcagaaatttcaacaactgattttgtatcggcaagataattaaagaattgattttcatcttcatgtaacaggtttgaatagtttttttttaccttttttgtagttttttttggctcgacaaacacattatttatatttttttcttgtttatcctgtcctgcttgaaatgtagttctattttccaaataatttgcataatttgcactatttttagtctgactataatattcaggactattttttgcctcaatttcattttgatttaaattaacttcagcttcctgaatgtttccatcaaatgggttagggttgcttaatttttgttcttttacataatttgctttttgaaagttgctattttgctgataattacggtcgcgggaggcaaaattactattttgacttttgatattactgttttgactagggtttctagggatgaaaaaatttgattgttttgcctccttaaatttagagtttgccttattttggtcctggtttcaattcataaaacccctttttcctcaattttttacttgtttactattttattttattttatttaattttaccataaatagctgattaagttagcctaatttttgggcaaagttaaaaaaaactattaacctaaaaattcataatctgttttaaaccttaatgtagtttaagtatttttacaaaaattaaccgaataaaacaaatttagctaaattttcctaaatttttccactggataaattatagttgataaaattagaatttaaatttaattactttgaatttaatatagaactatttttttataaaatttacttatttatattatataggcaaaaacaggatttaattgttttatttactgaatttttaattttatatttgaaattaagtttcaaattaaataaaaatttataaaaaacaagacttttttataaatttttctaaaaaaatgaaattttcgaaaaataaaaattaaacaaaaatcttttttcagagaaaaattacctagaaattaattactcaaatttttttattaattaccacttttgactaaaaatttgcaattttttctaaaaaattaaccacaaagttatctaattttaataattaagctaatttttggtcatttttactccacttaactaatttttatataaagaatttttattttttttcggtcgacttattttagtaaaaagtaatttgtaaaaataaaaaaaatatttttttggttttttttctttgttagtgtataattgtggttgatagtggagacaagcggaaatgtttggaactgtttttagaatattagacgagaaaaatagaattgtaatgcctcctgcttttcgaaatgaacttgaaggcgacttttatatttctgctaatttggagaaaatccttgaaatcagaagccagacagaatttgacttgttagcccaaaaaataggaaaagcaaattcactcgatcctaaacttcgtgattttgcaagatatttttttgggaatacagtcaaagtttctgctgataaacaaggacgatttttgatcccgaaaaatcttcttgatcttgccactatcagtaaaaatttatatttaattggggttaataacaaaattgaaatttgaccagaacaaagatacgaacaattttatgcaaaattttctgatagcgaaatgaccgctgatcttgaaaaagagttgctaaaatcgggagttgaattataaaatgcatgttccagttttgttagaggaacttattttagccctggaaattaacccaaaaggattttatgttgatttaactttaggacgcggcggacattccttagcgattcttgaaaaaattagtaatggaaaattggttgtttttgataaagaccaggatgccttagatcaaacaagaccaaaattattggcatataagcaaaacattgaaattatttggtcagatttttccagatttgatttctatcttgaaaatttaggaattcaatttgttgatggatttatcatcgatttaggagtctcatctccgcagattgatgatcccgagcggggattttcatattctaaagatggcaatttagatatgcgaatggataagagtcaaaaacttagtgcttttattgttcttaatgaatatccctatgaaaaattagttgaaattttctttaaatatggccagattccctatgcacgcgaaattgccagagcaattattaactctcgccctttgaagactacttttgagctggtgaatcttgtaaaaaaagtaattcctgcgctggtgttagttaaaaaaaattttataaaaaatgtttttcaggctgttcggattgaagttaataatgaacttgattccttgcaaaagttgttagaaaagttaccaaaatttttaaagcaaggatcaaaagtagcaattattacctttcattcgttagaggatcgaatcgttaaaaaagcatttttggatctaattagaaaagacaaactggaattttttcaaaaaggtttaccaaaattttctatgaaagttttccgaccaaaagctaatgaattaaagtcaaatccgcgagcaaaatcagcaaaattacgacttcttttaaaaaatagataaaaattggaaccaaaaaaaggtagaaatactatggaaaaatgtagtaaaattatgctaatgggattaggtgattttggatcaaaaattgttgagtcaatcaattttgatcaagctagttttccaaaattttttattaattcagctgatgaatatacaaattccaattttttaaataggcaaaattcactaattattccacaatcaaattttagatataactgacaaaaagcaaatcgggctattttagataaaagtttagaaattaaattggcccttgtcaatgttagaattttgtttttgattgttggtcttggtggcgcaactggttcaggttttagtcttgccattgcaaatattgcccaaaaaatgggaattatcgtaattgtaattgcaacaaatcctttagaaaatgaatcaaaaattcgccagcaaacgagttttgatgttctcagtgagctaaaaaaagtagtggattcattaattataatatcaaatgagcaaataagcgaaaattattctggcttttttcttgaaaatatatttaagttaataaccacaaatattcaagccaaaattggaattattcttaaggctttctgccaaaacaatgcattagttcatgttaataattcaatcagcgagtcgattcttgcaaataataactttgttttcgttacctcagcaatcgctaagggtgaaaatcggggaattattgcaactaaaaaggcacttaaaaaccattttgtcgaatttgatcttttcgctgcggaagaaatgttagtaacaataacagcagataattcgattttacaagccgaaattagcgatattcttaacattatccgcaaaaatttcaatcaagatttaaaattttcatacggactttatcaaaatccgcaattaggaaatcaggttgaaatcggcattatcgcatcacaaaaaaagcatagttatgaaagtaaaaaagcagcaaaattaaatcttgctttcgataacgcatttaatatcttttaaaaaaattcagttttaaaatttatttaccttttaaataaaaaaataaacacctttctaaaattataaaaattaaaagtttgcaaaccataattttataataaaaaggtgttttttttataatttttttaaaaaaattttttttacttgcaaactataaaaaatatagtataataaatatacgtaatttttcgctccttttttaaatggggctttgattttaaaactattatgtctaaatgaaacaaaaataaatatatatccgattattttttagatagtcaaaaagttcttgcaaaatttaacccaaacaacatcgtcattttacaattttttcaacgccgcgaatttgctattcttgctggaatgaaagaagttattgaattactaaaagaaaataccgattataaaaagtataaaattcgctatttaaaagatggcagccgtcttgggaggaaagaaattgtccttgaattagagggtccgattcatttatttggtcattttgaagggatgattgatggaattcttgcccgttcaacctcaattgccacaaacgcttatttatgcaaaagagcagctaacaataaggatattatttttatggctgatcgttctgatcattatcttatgcatgaaattgatggaaaagcagcccgaattggcgggataaatcttttttctaatcaagctcaagcaggaaatgtcagcttagaaaattttggttcaatgcctcattttttaatccaaaattttcaaggaaatttaatcgaggcttgtagggcatatgcaaaagtttttcccgaaaaagaattagttgcgcttgttgattttaacaacgatgttttaactgccgcccttgaagtgcttgccgaattcgggccaaaattagcgggtgtgcgaattgatacatctaaaaatattgcagataaaatgtttgtagatccccaaagtgatgaatttggaattaatgcaaaattagttaaaaaattacggcaagaacttgataaaaacaacggccaacacgtaaaaattatcgtttcctccgggcttaatcctcagaaaattaaaaaactagaagaagaaaatgcgccaagtgatgcctatggagtcggtgaatttatgcttcagcttcggcaccattttagtgctgatgctaccgttttaaacaatgaaaaaatcgctaagtttggccgcttttatcgaaaaaatccaaaattaatcagtcttgttaatgaaaaataatcttgaactgaataatttaggttataatgacgatctaaaaatttgacaagataaaactagctttaattattcagttgatacaattttgctcggaaatttccttactttatcaaaaaaaattaaaaaagcactagaaattggcacaaataatggcgctttggcaattttagttgctcatcgcaaatctttgcttgaaattgatgcactcgaaattaatgaaaacgctataaaaatagcccaaaaaaatgttgaactaaacaaaaaaggttcacaaatcaggcttattcatatggattttaaccatttttgacctttgcataatcaaaaacagttgcaaaaatatgacctaatttttgcaaatccgccttattttaaaatcggaactaaaaaattaaaaaaggttaattccgattttttaaatgccatctatgaatttagtcttaatttatcacagttgatttcaggtgcaagtaaaattatccaacaaaaaggcaagcttgcattagtcttgccaattgaacgttttgttgatctaattgaactattaagagaaaatcattttgaacccaaaaaaattcagtttataatgacccgggttggctcaagtcccaaatttgcactggttgaatcggaatttaaagggcaatgagggacaaactatcttcataatctttatcttcacccgcaaaataaaaatttacatatctatcgtagagaaattcaaagattatatgttgcaagaaaggtcaaagatgactaaaaaatgttatatcacaactccaatttattatgctagcgggagactccatattgggcatctttatacaacagtgcttgcatgagtaattagaaattttaaaaaaatgtccggatttgaggctagattgtttactggttctgatgaacatggtcaaaaaatttctcaactagctgcaaaagcaaatcttgaaccccaggaatttgttgataaaaatgtcgaaaatttcaaatttttatgagaaaaatttgaaattgactatgattattttcaaagaacaacaaatttaaatcataaaaattttatcaaaaaaatttttctaaaaatgtatgaagataatcatattttcaatggtgaataccaagggctttattcgataagtgatgaggaatttctcagtcaaagtcaagctgtttatcaaaatggaagctattttcaccccgttagtggggcaaaaatggaattaataagtgagaaatcctacttttttccgatcaaaaaattccaaaaatgactagaggattttcttttggaaaatcccaaattcatttttgattcaaaaatcgcaaatgaattaaggcagaattttttacaaaagggacttgaagacttatcagtgacaagaaaaaatctaaaatgaggtatttttcttgatcaaaaatttgaaaatcagacaatttatgtttgacttgatgcactttttagttatttatcagtttttaaagaccaaattgatttagaaaatcctaagaaatcaaatttttgaactgattctgcccaaattattcaagtagttggcaaagaaattgcccgttttcactgtatttattggccaatttttctaaaatcgctcaattttccccttccaagcataattttaactcacggttgactaatcacccctgagggaaaaatgtcaaaatcaaaaggaaatgtgataaatccacttgatttgctaaaaaaatttgatccagaaattattaaattttattttgtcagccaaataaacactaaaaatgatagtgtttttgatgaaaatttattagaaaatttttataattctttttttgtaaatacttttggtaatttaataagtagaacaattgccttgatagtgaaaaaatttgatcagcctttattatttgaaattgcggatcttgattgaacagatattagtttttatgagaaaatcctgcttagtttagatgaattttgcgataactttgatcaactagaaattgaaaaagcatttaaaacagtaattgaattaacaaaaaatttaaacggcttttttgatattaaacaactttgaaatcaaaaaaatttaaaaaaactggcccaaggtttaattttggttctcaatggaatttatgctataactgtttttttaagcatcgcaatgcctaaaaaaactaacgaaattcttgaatttcttggaattaacgagaaaaactttctacttattactaaattagataaatttgataaaattaatttcaaaaaattagaaaaaccattttttccacgaaaaaattaataacctaaaattcaacgataattatgttttttgtttaaatattggactagaggaaccaaacggattaaaattagggcataaattgggaaggaaacagttgattttaaaataattggcgttagataaaagaaaaaataatcctgaaccagacggtcttttcctttcctgttaaaaaaccgattataatattttataaaagcaaaaggatgtcagagtcagcggaaaattaaaaaacaaaaaccaagaacaaaaagtgttatcagagctatttttaacttttttgttcgtttttttcaataaaaaatcaacaaaaaagttgagaaagtaagcagaattgatccaaaaactgcaattaaaattagaactaattttttgctaaagacattttttcagtcttttgctactttttttattacttgttcttcactaaaaaagtaataaaaaaagacgaaaatgacaattatatatgttccaataagcaaaaatattaaaaaaatatctttttttgtaactaaactaaaaattaaagacgaaattattgccactaaaattggaataattccatattcaggggttcaaaaaataactcgacttgttagtaataatttaccaaaatcaaaactaaaagcaacaattattcccttaaatcaatgtaaaagtataccgattagaacataaaatggtaattcaaaagcgatattaaaacgagttggaacagtagttttgaataaaaaagaaacaattaagaacactgccattaaaaaaccagatattactaattcaaaactcgaaaaacgaaaaatcaaacggtttttgtaaaagaaatttttaattttttttacaaaattacttaaaaacagtgtcataatcacaaattatagcaaaaaatggacaaaaaatttgaaaaaataaccaagtaaataaatttttttttaaaaaaattacttaaaatattgcatatttttgaaaatttctaaattaggcaatattttaatttttattgttactaatatcaatcaaaaactaaaaaattaatgaatttatttttaaaatttatttttaaaaactaattttacttttcctcagtctctgcaaaaatatttaaggcgttagtagcagcggcaaattctgcttcctttatcgatctgccatatccaattccgtacttttttttctcccaaataagatcaacgcggaaagttccatcaactaattttgtgtgtaggtagtggatcttgtttgaggttgaaaaagtttgaattttttcctgaaaaattgactttgggtctttatactgtttttcagtatcaaaatttacatctttatataaatactcagacaagaattcgtttaatttctcaaaaccttgatctaataaaatcgccgcacaaaaagattcaaaaatatcggcttttaacttgttgttttcacgaatttcactagcacctctaccaagcaagacataattcattagcccaactttttttgttgcatttgctaaactcgaagttgatgtaagtaaggatcgaatttgggttgaatttccctcatttttataaaaattatcataaatcacctttgaaaccgcataattaattaccgaatcaccaagaaactcaagcatttcataatgtggtttatcaggattaataaaattataacttttatgagttagcgcttgaatgtaaatctgttttgaatttgggattatttttaatttttttaaaagttcaagaattttatcttcaatttccatttatctccttattttttatagaaaattttaaaaatttttgtctaaataatattttaaaattaaattaatcggcaagaaaatttattttaaaactttgttgcccaattatatgtggctgacttgagtgaaaatgaccaaattcaagctcaagttctaattttttattttggtcatcaaattgatgggccatttttataaaacttacttgttgggcaggaagattatcaggtaaaggaatttttgcaacaggtataaaattgagaatttttaattttactaactttttgattacaatgtaagttatttcaccttcatctaaacaggttcttgcattattagcacaagcgaaaggaaattcggtattattttgtgacttaatctcattaaaaaaattgctaaatttatttttaaatttattatatgaataattttgactagtcaattcaagacgatatagatcttttttgaatttatcatctggttgaaatgatggtatagaattaggctggctaaattcaattttaacactatttcccccacaagaaaccaaaaaattaacaactaaaacataggaaaatagtcattttttcattaaattccttctacaaattcagacaattaaatgtctaagttattttaaaattatatcataaaaagtttattaatgattaacatttaaatttaattaataatttctttagcggatttcttaacttttttccatttttttatataattatttagatacttaaatttattgcctgttattgaggaggctaaatgacaaaaaggaaaaaaattttactttcattatctgcaatttttccaattagccttgctattggcggttattttatttatagttatttttctcgggcttgattaaataaaaattttagtggtcttgagctacttctaaatgataaatccataaaagaaaaaagtcaaaaaaaaattaataaaattgatacaaatagcataagtaattttttagaatttaatagttatgctacttttgcaaatcaagaaaatgatgatttaaatatggaattaggtcagaaggaagctttttttagtatgctttctgattttgaccttgaaaaaattaagaaaaatcacataatttttcccgaagaatataagatgtttaattttaatactgataataattttgtcacaaaagaaaatgagaaaaaatttcttggctctgaaaatgatgatttgttagtctatgatctaaattatccaaaaattaatgagctaattgaggaaaaagaaccatttaaatctgatattttgaatcaaaaatttacactttttgattcaaaaagcagaaaccaaatttttcagcttgataaaattggtgtttattctcaaccacttaaatcaaataaatacgattcaatttaccaaaaaaatattaaatttcgcactgcaacggcaacgattttagatgctagtaacggcaaagcattattgatcacaaataatcatgtaataaaaccaagcgaatatagttataaagatgcaaattttcaaataaattcgcaaaatttaagattttgaaataaattaggcggtaattttatcgagtgatatgaaaatggcaagatttatcatcttgatagggataacaccgcttttcttttttatttaaaagaggtttttgagaataaagtcacaaagtttgatcaaggaaaagttttagagtttcttattgatttttataataaatatttcttaattcctactgattttgataataaaaaattcgatgttggcatattttattttaaatatcaacaatttattgaagacttaaaaaatcttgcaaaattttataatgaaaaaagggaggaaatacttaccagaattcaacaaaataacaaaattaaccataatagcagcgagagcaaaaacacaattgagtccaaatttaatgattttttaggctcatatcaaggatttattaatttctgggaaaaaatgcagaacgctcctgctgtaaaaatatcaccaaaaatttgaaaaaaaggagattttagttacgatctcaatctttccttgttctgaccaaagtcaaaagcgatgaaaaacaactttaaaggggtttatgccactaacccacaagaaaatttttctcgactctccttatatttttatacaaacaacggccgcggagcctcaggttctggtgtttttaacaaggatggcgaactacaatttattaatgcatttggcttaattgataatttttatacggatgattcgaaaattgaaaaaaattattacgataaattaaataccaatatttcattatcaggtgggatccccctggttaccgaagaatataatttagctgaatcgatcaaacaattttatccatcaaaccaaaagagtggctttaaataccttgccaatgaaaatgttaaagttataaaagttttaaaataaaaaactcgtaagtttcaaaattaataaaatttacgagttttttatttttcataccggcgcaccagttgatagaattattatgaggtgggaatttaacccatatttccaaaaataaataatatttagtttttgaaaactcataataaatatgaaatcgaaaaatattataccacaaaattatttggttaacatttttttttttttttttttttttttttttttagttatctatgttaaggctataaaaaggataaaaaaattattttacaacaaaaaaagtttaattttctaaaaatttaaatttttttattagaaataacaaatttttttacgaacataagattaaattttaaaaatttagaaaattttataattcttgtatttttgatagaaaatgttttaattttaacttatttttattttaattatagtaaaaaaacctaaattttatgatataataaaagagtttttataataatatggggtgaaaatatgttccaaactattaacgaaatttccattcatcctgaattatataaccaaaaaaaggttctaattcagggctggataactaacattcgcgggaatttaaaaattatatttgttgaattaaatgatggttcttcatttaaaaatttacaatgtgtattaaaaaaagagtttattgactttgataaaatagaaaatttagccctcggtgttgcagttgaaatttccggaattttttcaaatacacctgaacgtcaacaatttggcgaagttttagttgagactttggaaattaaaggtaataattataacacaaattttccgattcaaaatcaggaaatttcccttgaggttctccgccaaatgcctcactttcgccatcgaagtcgtttatttcgtgttattatgaaactaagatcagcgctattttttgaaattcataaattttttcgcaggcaaggatttattaatttttcagccccaattctaacctcaaatgatggcgaaggagctggtgaagtttttatcgttgatgatgaaaataaagatttttttaataaaaaaacgaccttaggtgtaaccggacaacttcatgctgaagcttatgctcttggttttaaaaaagtttatacatttgccccaacatttcgggctgagcgttcaaatacgagaaggcatgctgccgaattttggatgattgaacccgaagtggccttttttactttagaacaaattatcgaattagcagttaaattacttcaaaaagtaataaaatcagtaataattcgcaacaaagatgagtttatttttctagaaaaagccggggataaaaatctccgaaagcgtttgcttcaattttgtgattctcaagttactcaaataagttatgaaaaggcgattgaattgcttttagaacatcaagaaaaatttgaggaaaaagatttattttttggctgtgatctaaaaaccgaacatgaacggtttttaaccgaagaaatttttcatatgcctgttgtaattataaattatcctaaaaatttaaaagctttttatatgcatcaaaacgaagatggtcaaactgtagcagcctttgatttattggttccgggaattggggagttaattgggggctcacaacgcgaagttcgctatgaaaaattattagcgcggatgagtgaattgaatatgaatattgaagaatttcagtgatatttagatcttagaaagtatggtaatcctggatcaagtggttttgggcttggttttgaacgacttttaatgtatattactggaattgaaaatattcgtgatgtaattccctttccccggacaagtaaaaatattctaatgtaaaacagggagaaaattgaataattctgaaaaagcacagttttgacgtcgctttctagctggcttaattgattttatcctgctttttgctttgtttttattatttttttatttatttttgattctaacaaactgagcaaaaataaaattttacctctgaattataacagttttttttctaacttttacttatcgaatttttatggtaagtttttctttacaaactttaggtcaatttttaactaatacaaaaatatattttcttagagaaaatcttaattttaaagcaaaaattttagttttactaaaaaaggaaatatttttaagtcttaactgaattttaactatatttattactagtttattagttgatttaagttttggtcttaattttaatttttttgaaaattttatcagtcaaagtcaaaaactaaatttattccaacaaattagtcttagttttccggccttattagcaaaagttaacttttttttcttaatcattaataatttatcaatttttagtaggcataaaacaacaattattgaccgttattcaaataccgaaattcatcttaaaaaatcaggtctagccaataattttttaaatgcaattccggcgaattttatcccggttgattggaaaggtaactaaaatgtcatcgcaaaatattttattacaacttaatgaaaaacaaaaaattgctgttatcagtaactctagccatctaagaattgttgctggtgctggcactggtaaaactagtgtgctaaccaaaaaaatcgcttatattatcaacgaatctcttgcatatccaagtcgaattttagcacttacttttacaaataaagccgcagaagaaatgcgtaatcgggtggaaaaattagttggggaaaaatcaaaggatattcaaattcttacttttcattcactttgtaatttaattctccgacttgaagcaaaaaatattgttgaactctctgagattccgcttagcgactaccgttttaacattattgatgaacaagaccagaaaaaaattgttgaaaaacttttaggaaaatatctaaaagcaaacgatgaccgcgatgagacaaaaattagtgcttttgatgcaattaaattcatttctaatgccaaaaattgagaaaaatcacctgaggatttgctaaaaagtataaataatgaacttgatcaaatcaaagttcaagtttatcaaaaatatcttgaaaaaacaaaagaaaataacattattgactttgatgatcttttactttatactaaaattgcctttgaaaaaagtccagaaattaggtctagatggcaaagaaaatttgattttgtccttgtagatgaattccaggatacttccttggtccagtatttaattttaaaaatttttatcaaagataaaacacgtttagttgttgtcggcgatcctgatcagacaatttattcttgaagaggagccgatccgtctttgatcttaaatttagagcaagattttcccgatctccagacggttattcttgataaaaactaccgatcaacgcaaaatattctcgatgcggctaataatttaattgaaaataaccaaaatcggatcaaaaagaaattagttgctagttcaaaggaaaaaatcgaaattcactttgaggatttagccaatgaaaggggagctgaagttgaatgaatttaccgaaaaattcaggaattaatcacaaaaaataaggtaacttatcgcgatatcgccattttagcacgctcaaatttttattttaaacaaatagaaactaaatttgatggccataatattccgtattttcggcacggagcttccccgcttgtaaccaaaaaagaaatccgtgaagcgctttattttctaaaagtaattgataattccgatccttatgcttttgaacagattatcaatgtcccgcctaaaaaaattggaatagcaacaattaacaaactaaatgaattagcagcccaatttggtcttaatttacacgattttttatttaaatattattctggtaaaataaattttaaaggaaaacaaggaaaaattcccttaggccatgataatcagcttaaaattaaggtacttttagaaagaattagcgccgcaaaacggtttaaaagtcaaattgaagaaaaaaaaccttgtatttttcagttttattcgcaagttcttgactcttttttgaaaaaaattgattattttgatgcaattaaagatgcaaaacaagcctctgatactcgcaatcttttagaaaaatactataaaataatggataattgacaaaaagccaatcctgaaaaaaaattatccgactatcttgattatgcagctatttctcattttgaacaaactgaatcacaaaataaaattaatttattaacagtacattcctcaaaaggtcttgaatttgaatatgtttttcttgtgggaatgaatcaaggggtttttccggcccaaaaagtactcgatcagaactcgacaagcgaatatgaagaggaaagaagactcgcttttgtagcagttacgcgcgcaaaacgagttttatatataacaaatggttatcgcgcgccttcttttgcccgcggtttgccacaaaaatttaaaactaatcaaaatattgtctctgcttttgttaaagagatgaaaattaaagctgaacggtttgcccagtttcgtaaacttgatgaaacaggaaaactaaattataccaaagataaatcagaaatagtggaatttgttgctggtgaccaaattaatcacttaaaatttggtcgtggcatcgttttagaggtcagatttgactcaattttagttaaattttttgaaattcctggcgataaagggattaaaacactaataaaaacacataaatcaatcgataaaataacctaaaatgctattaaattgacaatcttatttactcgttgccctgattattttaatctcgctttcgtttcttcttttattaatttttagcttagtttttatttataataagaaaataaaaacaactaatattgtcccgctaacttacgatgttgatctaaaaaggatccgaattaacgatgttttttcgctcccggccctcaaatttataattaaaaacaaaaatttactatccggactttgaataactcaggcggattttgtcgaacttcttgaagagaaatttcaaaaaatttttttcaatagccttaccaattggcaaaagcaaataatttcaataaaatttaaaaaaaaatttttttttaacaaccattttcaggttttttttcaggcaaaaccggaaaatggttttgttatccaagaggtagaaaaaccatttttttctttaagaaagaataaaaaaatctttaaaaatcgagtagtcgaaaaattaattctgaattttgagcttcccagttttcttatagcttttagttttccagccaaaataagtactgaatttattaaaaatttttttcttgcatataataaaaaatttttatttttgaaaaaaatttcagattttcaaatttttagcttcgagaatattttaataatgcagatttgcgcaaaatcgacaacaatacttgaaaaaataaaaaattattataaaaattatctaaaaaatcataatttaactacttttttattttgacttattattgatctagaccgtaaaattaattatgactgaaaaattgaaattcagaaattttttgatttaattattaaggaaaaaaccaactttttagagttaaaatcaagtagaaaactttttcgacaaattattgagactaacgaaattcagcccttatttaatattgaaaattataaaattggcgaggttaaagattttaaaaatcataaaattttctatcaggtctatgattttgacttttataatagtcaaaaaatttcggacttactaaaattttttactgaaaagtcaaattttgaccattctagtaaaatttataaaattaacgatgtaattgcgcaaaaaatgcgtaatttagtacttgattttcaaaaattcacctttttaatcacttcagaaactaagattgctgatattgatctaagttatattgacaatctttgctatcaaaaaactgttgattcaaaacttttttactatcttaataccaaaaaaccaccattattattcctaaatgataattttaacgcgcttgagaaaaacgaggcaaacgacatcattatttcatcgcttggtgaatatgcaagaaaagaaaaaattaagctggtaattaaaaaagaaatgatcagaagatttaatttttcccagaaaaattttccgctttattattgataaatcggaaaattaaccaatttttccttattttttccttttttaaagtttttttgcaaaaaattttaattttagttgaaacaaaacaaccaaaagggagcaaaaaatgcaaatctatcaattcggaaaaattgtctcaaaaaacaaaaactatttaattcttgaaaaccacggcagtggctatcttatttatgtacctcgaatcgatcgttttagccgcgacgaaaatcgcaaaatttatatttatgaacatgaaaatgactatacaaaaataacttacggttttgcgagcttccgtgagcggattttgtttgaagatctaatttcaattcaaggggttggacctaaaaccgcaatttctgcacttaattcgggaatgcagaatttaattaatttaattgccgcaaacgactgaaaaacgctggcaaaaattccttatctttctgagaaaaatgcaaaacaaatagtctttgaatttcaaaaaaaatacgaaagatttaacgaaaaccataaaaaccaaacagaggaaacaaatcaagactctcaagaaaaagaactagaaaaaaaggatgatttagctgatattaccatccaaaaatcaaatcttgaagacaaaacggccgcaaatcttgaggatactttgaaaatgcttggtttcaaaccacgtcaaattgattatgcgcttacaaaagttgaacctaatgaaaattttgaaaatttaattgaaaacgcaattaaaattatatcaaatgccagagaatttagaaattagaccaagcagttttgaaaattttatcgggcaaaaaaaattagttgaaaccttacaaattttaattagctcatcacaaaaacgaaagcaatcacttgatcatattctcttttatggaccaccaggaacaggaaaaacgacactggctaacatcgttgcaaatgttcttgaggctaaaattaaatatgttcaggggcctttgcttgaaaaaaagtcagatgtgcttgcagttttagcaaatatttcgccggataccatcatttttatcgatgaaattcacggaattaataaaaatattgaagagcttttatattctgcaatggaagaatttgtaattgatcttcagattggcgttgatggggagagaaaaattatgcggatgaaactcccgcaatttacactaattggcgcttcaactaaacttgctcaaatttcaacgccattacaaaaccgttttggttatgttgctaaaatagttgattatacacttgaagatatgatccagattattcggaattcctcagcagttttaaaacttaaaatgaatactgaaattattaaatatattgcaagtttttccaataatacaccaagaattgccaataatttattaaaaagaattcgtgattttgcgctagttttaaatgcaaaacgaattgacaaagacattgttaataaaacttttgatagtattggaatttataatcaaggtctttcgcagataaatattgaatatttaaacctccttgtaaaaatttttaagggaaaatcagtggcacttgatgtaattgcaaatgttttaaaagaacatcggcaaaccattatcaatattattgagccgccattaattgagaaggaattaatcgagaaaacctcgcgtggtcggaggattactaaaaaaggtagggattatttactcgaactaaaaactaattaagttacttttttagctttaattctcaaaaagtgtaactttttggggtttgattaccttaatattagacgcattatttgcatttttataaataaatttgagaaaatctcagaccataatcattgcaattacatcattttggcaataaatttgcaaatttttctttgttatttcccactgattatcaccaataaaattaaaataacgatcaattgattcgatcatcgcctcaagtccgttttttattgctaattgtttataagggattattaatcttttaaggttatatttatattttgtgataaaattttcaatttttttaattgaataacagcccttaagatccgagattactagtcaatatttcgcaaaagggtcttttaaatcaatcgtttttttaataatttcagctacttttaactcatattcttctaatttttgttttgctttatgatatggaagtctttcaagataatttttgaaaattatctcaagcatttcttttagtctagtgagttcataagatttattaaaaaccacataaaaatcggcatgtttatgataaattttatcaattataaggaaaaaattttctcaagtataattttttggatcaaaaacaagatttctatctgaaaaattttgattcaaaatttggcctctattagttaaaactatcgaaacctgggaaacaatttgctgaaagggttggacataatcaattggcggaaatggaagggaaaaagcttcaaaatcataccagacaattttttttgcatataaatttagtaaaaatttttttaattcctcaatttgattaataataatgctattattttcttgaaaaaaattaaatcaaaaagaatttttttcaagcattagtaatttttcttcatcttcgattagcgataaggcatcttttgcttttaaaagggtaccactaatatttgcaagttgaggataaaattttgtcatcagcatattaaaatcaggatttttttcaaaattcccattatcagaaatctgtggtggactaaaagtttttatgtttttagcctctttgatttcggataaagcatcaattattggaatcattttgataatttttttggtttttttaggcccctttggtgaatttctactaactgtgtttctaagaagatttttaacaagacgattttgttcaagaaaataaggattattaaactctaaaagtgtaaggccgttttgtttagcgattttttttgcaaaaaaataataaggaccttcacgatctatttttgaaactgacttgacacctttgttagttgaaactcataatgtttcacaaaattcagtttgattttttcttggattctcaactgtatcaattaaaaaataagaaacttcttcaattggattaagatcatttccaaatccacgaagcgcataagttgtaattcaaaaatttcaatttgcggctaaatagtctttaatttttgttgaagttgataattttaggatgcttatttttttattaaatacaaaaaatacagaagaatgagctacggcatctttatattcaaaacatgggttaaatataatatcacaatttccacttttataaaaactaattgtttgcgcaatttttttttcaacttctgccggatagacaatgcaaattttcttctcaggatatttttttttaataaaagtatgaaattccgttgtaaaatttttaaaaatattaatgtgtaattcagaaaaatcggtaggattttcacttaaagcttcaaaatttcaaactgtattctcaaaattttcctcatcaaaatcaggattttcgggaaaattagaatctaaattgtttcagatgaaatatttttgtcttgtatgtaaacgaaaatagtgggaaaaattaatttttttcatctagatctaccaaatattttaaaaaattatgtatcaatttctaattttttttctaaaaccgaatgcttaatttttaaaatatttggtgaatcgactacattttgatcaaataaacgggtttcacgtgctaatttattataaccagcaacaattttataaatattatgctgtttctttcatggtagttttactcggaaaataaaactatttccctccccatcagctggccttatataattcgcgatatactcaacatcattattatttatttgatcaaaacccgatgatacaccttcattctcgcgcttgaaaactaaagaataattattaacagtatttgcttttacaacaccgggactaaatttaacttcaaaatcaacatcaatattttcaagactagaatcaatttgtccagcgaattttgcatttgagacttgaacatcaataatatcggcttctgttcgaaatgataaggggaataaattattatcataagttaataattttcctttttgatcataaagtcccgaaattacataattagtatcacggtctaaattttttagactaacataaagaaattgatcagatttaacattatgtttaaaagattgaatttcataatctgatctaatcatatttgcttttcgataatggacatcgataagttgggaggataaattttgatcagaaagagctacacgaaaatcaaattggcttgaaggatctaatgaatccatttttttatatgaattagaaataatcacaggacttggattagttctaaaaacattacctttaacaaataattgttcttctatttgaccatttaggcgaataattttaattacatatttagaatcaggttctaaatcagtaatttttaacaaaattttaggttgattattatgcaaagcacgacgagctgaaaattgaacttgttgataattttcagtattttccttttttaattcaaccttaaatagtttagctattttatcctggggaatgattttaacattattaagaacaagttcgacagattgagattgaagattttggactaaaatttccggactttcttgattaccacacgaaacaagaaaactaggaaaaataaccatcaaactggtttgaaagattaggcaatttactttcttagttcagcttttcattttaaatccttattgtcttcttcttgtatcttaaaaaattatatcatttttcaaaataaaaccaaaaaaaattagaaatttttcctaattatatttatattaaacaataaaattattcttaatttatttgaaaaatttatattccaataaaattggtacaattttatcaaaataatattttttcaatttaacctttaaagtttcaatattcccatttaattcaggatagtcataaatatatttattcgatttccggttagggattaaagtttttgtatttagttagttcttcatcgatctgataaagtccgtatttaaagtgtttttcgtaatttttggtttgtgccgcttgtttaagaattatttttcagatctctaaaagttccttttcttgatcgtcaaaatcataatttccaagactttttagagctaaagtttctttttgactaagatcatcaaggcataattcatttaaataaatagttgaattatttaaatctggatgggctagacttctgatatgattagttagactcaggctgacaaaaaataagtttgaaagcaaaaaacattctaatttatagtgttttttgctttttagttcttgtaaaaaccggttaaaaccatcccctgatttaacaagataggtattttctcatctaccatccattattttaaaaattccggcactaaagacgataaggccgactaaaaaattatttttatgcaatcaaaaatcgttttcgcaataagactttgctcttactaaagcggatgatgcggaagaggtaaagataagcacacttgatcttaggtaagcaataaaataatcattatctaaattttgtagcaggccgtacaaacttttgccagttcttatgctaaaaagaccgttatattcgcaagaaagtcctttttcagggacgaccactctttcgagattttcgctttttcatttataaatagtttgactaaacatttttttagttttttaaatttttactgttttaatgaaaaaaatttcatttttttctttactaagagaattatgcggttttttaaataatttattaacaacgtttttttgggcatctattaaatacattattttttattctttttttggggtaaaagcgcaaggagatagttaagatattcaattagatttatgttatttttgctagaaattccaaaatcaactagcattttttctagttttttaactaataaattaacatcattttccttgttaagaatttctgtattaaaataattaattcgaaaaacatctaaattagttttataaggttgatttttcttgatccaatcaaaattttgctctttttttgttccaaaaccgtgatttatccgaaaaagtctttcataagttatgttagttgcgatattattttgattgtttgtgactaaagtaaaaattctgtttccgccatcctgacggttcaactctcaaactgcatgaccggttgttccacttccggcaaaaaaatcaagaatttttgcatttttattgggatgaatattaattaaatacttaattaattcaattggtttgggatgatcaaaaacctttgttgaaaaaatatttttttgctcctgggtgccttcagttccttgggctaataatattaaattagaaaatttcgaaactctttcaattttttggttattgttatcaacgaattggtattgttttgaaaaaaccttttcatttttgaaaacaataaaaccatttttgattcctcaatctaattttttcctagctcaacgccatctccaatctttaacagcgcggtttccctgatgcctggcttgtcacttttcttgactcccgccagcataataaattttgccattatattcaatcggataatcaagtccttcagatcacgttaatgaggcacgatcaagttggatcaacttatattttcctctttcttgaatatactcatcagaaaatttatatgaaccgtcattaatattttggacataaatatttgttgttaaatgttgaatgttttttgaataagctaatacatactctgttaggacttttacaaatttggagtctgccgctgatccctcgtttttcttttgccaaactaaattagcaacaaaattttcctcgccaaaaatttcatccattaaaacttttaagtagccgtgttgattatcatcaattgagacaaaaattatcccgtcgtcttttaaaagttttttggctaaatttagtcgctcatttaataaatttagtcagccatttcgcgagtatttatctcggtaaataaattttgaaggtaagatattttctttatcatttgcaatctggttgccttcattaaaactagcctgagtattataaggtggatcgatataaattatatcatacccggctgcggtcgctctctctctctctctctctctctctctctctctctcgagaactaaaagatttttaagagcatcataattttcgccaattattaaagtattttgattttgattattttcattggatttaaaactaagattttcatctttttctaaaatagcaacagtatttgtatcactttcgggggcagaatcaaagcgaaaaccggttttaattcgctgaacgacaaactgatagacatattcaagttccttatccgggaatttttcaagaattttgtaggctaattgtttttggtcagaatttagttcttttgatgaaatttcatctaatttttgtttgtatatttctaataaattcaggatttttgaatctgtcattgaaactttcctttattaagataatttttgtcataaaaaatataaaaattataatataatttgctaatatatttagctaattttactttggttttcctttttttaaaaattaaattaagaaaataagaaaatcaaattcaaattttaagttaaaagtttaatttaaaaagtaataaatgcaaaaaaatctttcttagactaacttttttttagttttttgaattttttgggctaaatcttaattataataaccaaaaaattcaaaaaaatgacgagaaataaacaaaaaaacgcttgaccaaaaagtctaaatttaaaattattactgtttttacgttctttttatattttttccctggttttcctctactgaggcagtttcgccatcttttaacgtaactgtaaatgaatttccctcggaagcacgcataaaattatcaacttgcagaggccgcgctatgtttaaaacctttttaatttcagatcttcactgttctcaagcagacgaacttcttaccaagtgcggattcagtgcggcataactttgttctcaaattctgcttgtttttatttcgcctaaatttgaaactgaatttcccgagacaaaataaaccgtagttcccactgaacctgcaacaattggagtcaaagatagggcacacttaaaaggtcgacgcagtttttgcttactttatttacatttacaattcaaatttagtaaatcaaaactcaaaactaaaccaaaagtttcaaagaaactttaaccttataaattatatcacaatttttaataatattttaaaattttatgttatacatttctgaattaaaagcttgtttttaaaaatattcaataatttcatttttagattttttttttttttttttttatgctataatttatagttactttgttcattgtcaagtggaggcgggatgattaatgttaatgaatttcgacctggcattacttttgaatttgaaaatgaaatttatgtggtaatttcagcccaacattcaaaacaaggtcgagggcaagcgaatgtaaaaacaaaagtaaaaaatttacgcactggtgcaattactattaaaactttttctggtggagaaagggtcgaaaaagctcatattgagaaaatttcgatgtcatttctttataacgatggtgcaagtatcgttttaatggatgattccacttatgaacaagtagcaatcgagaatacaaaaattacctgggagcttaattttttaactgaaggaattaaggtaaaactacgaaaatttaacaacgaaatccttgatattgaactcccagctaaaatcgaattaaaaataacttcaacttttgatgctgtaagaggaaatacaacaacaaatccaacaaaacgagcaacattggaaacaggttatgaaatcgatgttcctttatttattaaggaaggcgaaagtgtaattgtatcaacagaagatgggaagtatgtctcacgagggtaaaaacgaaggataaaaaataaaaagggaaaaaattaaaatgctcaaaaataacattgaaaatttagcaataaattctttgaaaatgcatggtgttgctgcggttaataaagcaaattcaggtcatcctggagtgattttaagtgctgcgaaaatggtttatgcattatatcgcgatcatatgaattttgatgttgaaaatctaaattgaataaatcgcgatcggtttattttatcagccggacatgcttctggacttttatattctttattatataatttaggaattctagagcaaaaagatcttgaaaattttcgccaaatgggatcaaaaactccaggacatccagaatatggacatactttaggagttgaggcaacaacaggaccacttggtcaaggaatcgcaatgggtgttggccttgcgatggcgcaggcacatttgcattctaaatttcccgaaattaatcattatacttatattttatgcggcgatggcgatctccaagagggaatatcttatgaatcactttcgttagccggtcatctgaaactagaaaatcttattatcctttatgattcaaatgatatccaacttgattcccctcttgatgtggtttttagtgaaaatgtccgtcaaagaattgaatcacaaggtcttttttaccaattagttgaaaaaaatgatgttaatttaatctcagaagcgattactaaggcaaaaaaatcaaaaaaaccaagttttatcgagattaaaacaattatcggcgaaggtacaagcaaagaaaaaacaagcgatgtccatggtgctccacttggaaatgatattcttactttgaaaaaaaatcttaattgagaatatgatgatttttatcttgcagatgaactaagacaacactgaaaaaatacccttggaaaacgaagtcaaaaagcatttgctgaatttaaaatttcaaaagaacttaaagaatttcttgaaaaagggcaaaatcttgattttgaaattgatttagatctggcaaaaaatcaggcaactcgtaatacttctggccaaattcttgattatatttccaaacatcttccttactgaatcggaggttcggctgatttatcagtttcgacgaaagccaaagggagtgatggagtttttagttgccaaaattaccagggaagaaacattatgtttggtgtccgcgagtttgcaatggcctcaattgctaacgggattgctttacattcagttttacgtccttttgtttcaactttttttgtttttgcagattatctaaaaccagctttgcgactttcagcaattatgaaattgccagttagctacatttttagtcatgattccttaatggtaggggaagatggaccgactcatgagccagttgaacaactcgcaatgttaagatcattaccaaatcttgcagtttatcgacctggcgatgaaaacgaattaaaagcagcctatgaattaattttagcaaaaaaaaatcatccttcagctctaattctgacaaggcaaaacattaaatcttttaattcctgcaaaaaaggctttaaaaaaggagcttatttaataagaaaagcatcttcaaaatgagccctgattgctaccggttctgagctcggtcttgccaatgaaattgctaataaattagatgttaatctaatttctttatcaaattgacagaatagtccaatttgagatccaaattatgcaatttcacttgaattagccacaacttttggctgaaaagcgcatgcaaaatataattttggccatgatgatttcggattttcagccccagctgataaaattttagaaaaaattggctttaattttgataatttagttacaaaaataaagaaaattataatttagattaaaattttctttatttttgtaaaaaaacattaatagaaaataagtaaaaattctcactttttatttttcttatttcaattaaaaatatggacctttttaattgaaataagatttttttctatttttaatttttttagtgtataatattatttaattatttctccctattatgtcagaaaataacaactcgtatttatcgactaagcttgaccatttttcggcttgaaaaaaagagcggaaaattgctctaattttttctttgattattcttggaatcaccttttttctggtgggttatggaatgattaataatcgccaagaatttgtggttgataaattttattttattagttttagtaattatttccaaaattttagtgtttttttctatctaacttaccagtcaaatctcatttatggacttgttttatttagttttgtcctaagaccttcaaggctaaaattccaatttttatttgtttttacagtgattttaactattgttttaattgttttttgaaccgtaattgcctgaaatttacatatggatattacttttttgctaaaaacttcaacagtccatttttttcatcccgttttttcaattctcgtgcttttttggtttcgcaaagaatttatggtcaatcatcttggcctaagtcttgctgttatttattctgtttgttattatttattttgtctgcttttatatttttttacaattagacagtgaattagtcctgaatttaaggcaaataatgaaaatatcccagaaaaaaggtcagtttttttctatacaggactaacaatttatccctttcttaactttttacacccatttttttattcaggtgataatcattcaatggtgattctacttaatttgctaatgagtttctcagttgtattacttccttattgaatttcgcttttttacattaatgtttttggaatcaaagcactaaattgaagcttttttgcgtggattaaatcgctttttattcgcttaaaaaactttttttgggttgcaaaaccaaaaaaagaagaaaattttggagaaaaatagtggcaaaaatcgttgtaggactttccggtggggttgattcagcagtgagtgcttatcttttgaaaaaagctggtcataatgtgattgcagtttttatgcgtaattgagactcaagtcttaataatgattttttaggtaaaaaaaatgaaaaaaatttcactatttgccctcaagagcaagattgacttgatgctaaagtcgtagcaaaacagttaaatatcccgattttccgtattgattttatcaaagaatattgagatgaagtttttagtgacctaattttaaaataccaaagcggcctaaccccaaatccggatattttatgtaataaaaatattaaatttaagcactttcttgactatgcccaaaaagttcataatgctgattttattgcaatgggccattatgcaaaaacagataatggaaatttgtatgccggagctgattctttaaaagaccaaagttactttcttgggcagttatcaaaatcccaacttcaaaaaaccatttttcctcttggaaatctgcataaatccgaggtaagaaaaattgctaacgagctagggctaattaatgcaaaaaaaaaagattcaaccggaatttgctttatcggcgaaagaaaatttactgattttcttcagaattacattcctgcccaacccggtaatattattgatatttctacaaaaaaagtgcttggaaaacatatcgggattatgtattttaccatcggacagcgcaaaggttttggactaagcgggatgaaagaaccttattttgtagttggtcataatttaaaggaaaaaattttatatgtatcaccccaaagtgaaaaaaaatgacttgaatctgatagtttaatggctaaaaacgctaattttttaagtgaaaattttagaaatcttgataatttaagtgcaaaattccgttatcgccaggaagcaatcccaattaaaatcgaaaaaattcaggataattccttctgaatttcctatcaaaaatatcaggcaatcacgccaggccaacaagttgtaatttatcatcagaatcaagttattttagcaggcgaaattgctctactttttagaaatggaaaaaaacttgactatcttgactagaaaaagcaacttaatatattcccaaattaatttaaaaaattaaattaatttgaaaaaagtgcggttataaccgatcacttttgatttgattgtttgcagaacatcaaaggaattaagtggtctatctaaattgcgtgcaatctcacttcagttgatttgactatttagaccaaaaatttctaactggtactttccttgtccgcttgttaggccactaagataaatcaacccatattttgacttgataaattcaaacttttcttctgaatctagtcctaatttttgagctattgatccagcacaaaatagaccaaaactatttagaattggatattcactttcgaataaatcataaggatttttacctggttttaactcggttttatagtcgttttcttcctttataattcctacccgaactcaggaattaagaccgactccaagtgaatttgtctcggcaaaacttgtaattattagcacatattccttaattttttccgattctgaataaatttttagatcaaaattccgcgcactaaaaaagggactagcaccttgttttcctaaaaaatcaagatcaagaacatggtaatcattttcgcggggcaaaagtgcttcggaactaaaattgattggttgaaaatcaagaaaaaaattttcttgattttttggtaaaggtgcatttaattctgactttgatattgatttctttgaaagcaaattgttttccatttttccatgagaacgatataaaaacgaagttattccataatcaagtacatgatttttgatcaattcaagaaaatcatcataaaaaagccgcttatttttaagatcctctggaattatattttcaacatcaagggcaaaaacctcaagtcgataattgtgatcttttaaaggtggcagaggcccaaaataaactccatcaggatgttcacgataaaattcatctagcaaataatttgttgcatgctttgtcattgaattttcaaattgatacattttttcaggtcgggcaaaggaatcatcccattttagcttattttttttaatatttgccgcaatccagtggataaaaacaaaacctaattcaccagtggcttcataatcaattaaggtgacagcataagattttgccgctttaattttatctcattttagcggaaaactaactgaattagggtacttttttcctaaattaccatttccaaatttagtatctagaaccccatttttaacatttttaatataaatttttatcataatagctacaagaaaatatttttcctatttttacaagttaaatttagtttaaaaaccctgtttaattatttagttttttgaattttttgggctaaatcttaattataataaccaaaaaattcaaaaaaaagacaagaaataaacaaaaaagcgcttgaccaaaaagtctaaatttaaaattattactgtttttgcgttctctttttattttttccttgttttttcttctactgagacaatttcgccatcctttaacgtaactataaatgaatttccgccggaagcacgcataaacttatcaacttgcagacgcggcgctatgtttaaaaccctcttaatttcagatcttcactgttgtcaggcagacgaacttctgactaaatgcggattcagctcggcataactttgttgccaaagataaattacatattctgcttgtttttcggtaatttgtgtttttggaaagctagctataaactttttcatttggtcagaattttttagtctatatttcgaaatccgatttttagcttcattgaaagctttttttatatcatctgattccctacccgtaggttgaacttttagaatttctaaatccctttcaatatccttaattattttattaacggcttcttggttagaatcaagaggtgtatgaatttgctggttattatgttgtttttcctttggtttttcatcctttttaacttcttttgggctttttataatttcttcttgctttttagtttcagcttttttattatctgattttttttcagttttttgaacaacattcaaattttcgttttttgttggttttcgagttaaaagctgtggagttaaaactgaaggaatagactgtttttcttgatcttttttctcattttttggagagctggatttttgaattacaatactaactggaggaatttttgggtttaaaaggtttttcactgatttatgttttttatcggtactgattttaggtggtattgccggttttgtttttggggtttgtttatctttaactttctcttgttctacaatgatgaattctttatctttttgtctctgagcagggttgttttctggagcttttttatctaaaatagctatttgaactgggttttttgtttcattttttgatggttcgggttttttaattttcgttattttttcttgcggtttttccctggtagaatcaacttcaattaaaattttcttgttttgacttggttttggagcgacttgtggtacaattttttcttgtttattagaaattataattgttgttggtttaagtttttctgggttttttgtttttttaattaatttttctggtataactattggtgttttttgaattttaggagcttgtttttcttcttgtttttcgggaatttgatttaaatcattaatctgtgaaggagaaaatggctcaaattgactttgaatttgtacattttccctgcttgtttttatttcgcctaaatttgatactgaatttcccgagacaaaataaaccgtagttcccactgaacctgcaacaattggagtcaaagatagggctcacttaaaagatcgacgcattttttttaaattaaattttccctttttttaatcattccctgcaaaaaattacataaaaacatattttttctatttatattataacatattatcactaaatattcaagctataaattaaaactttttgtttacttataaaaaatacctaaaaaaaataaatgttttgattttttttaggtatgattaatactataaataaaacaattggaagttttatcttttcaacctatcaaattcctcaaccttatcggatccaattatataataattgttatcgaatctgccgctcctcagaaattgggaatatctatcaaaaagcgaaaggcttgataaattattctcaagatttgcgggttgaaatggtaaaagtgtgccttttgttagaaaaccaccaatatcaattcgtctttgaacataaaatattttaggattatccggatcttgtttctttatttccttttctaattcgagcaaatttgcactataaaggccaccctgagaaaaatttgctgtatttttataatactcagtcggttcaaatttatgaattttatcgttaaacttgtatttataaaaatcattaacaagaccgatattttcaatcttttgtggttttggactaggaccttgaactatcggcggttttttttcttctttttcttgtttttcttctttttcttcttttggttgtggtttttgttgatcattattttttaatttactattatcataagcggcaaaattcaccggttttccataaaaattttgattttggggtaagtggggacctaattttggaagattcggttgctcttcaaaaggatcttttcggtttaaatctggattttgttctggttcaattgatttatcaccattatttatttcagaatctgggtttgaatcaacgattcaataaagacggtaaattgcgtttttaattttgttttctttctcatcggcaaaagttttatcatcaacaaagaaaaaagcgcgcggctgaaccttgtatttacggccatctttgcctattattgtaaatttttctagtcttgttattagttctaatttcttttggaaatctttgtcattaatcaaagggagtttcaaattatcagggtttgatatgtcatttatttcccttcttttttggagttctaattcctttaactgtctgtagttataatttcatcagtaggcatttgaaagtggttgggttgttgcctcgcgaatcgtatcgacaatccgggcaagcgcacccctagggattgggatctggatggcttgtttttcgtctttttgctctttttcatcattttgttctactacttgagcttctttgggttttgttttttcagaatttccttgagcactattagattctttattagcatcttcatcttcgctctggttctgggcttgactttgtcggtcattttcatcttgaccatcttgattttgcgggagattttttaaggcttgggctaggacattcggatcaatttggttgggcgaaattggaatattgttatttttttgttttgggaaaatctcattgagataaaattttgcataactacttactagtttataataaagataactttcatcaaggtcgatattatttactgaaaacccagctccataatcctgcataataaaatcgggatttgcctttaaattagtagattttaggtatttttcttgggaaggacgccatttttttaaaaattctgatgctgagagataagaagttccttgataattttttctgacatattcaggaaaatctggatctttagcaaattgttcaatttttttaaggattacatccttttgctcattatataaaaaacgctgaaataagagtggatttagtcctggatatatcaaggaatcttcataatattgactaataagagcggaaaaataatattcggcaatcagatttttttcaattgcaaggggaatttctagcatttcttttaagagttggtatttttctgttgcttctggatttgaaaaagttcttgtatttaggtcttcttttagaatagcatgatccgaacaagcagcagaaatcaacggaaaagtaaatgccggtaaaattaataaattttttataatttttttcatttttagttagcccgccttatttttatatataaaactataaaaaattgggttatgattttttatagttttataatattatttaaagataaataataccatattttttaaggaaaacaaccattttattcataaatttctttataacccattcttcttcaaaaaaatcctttaaattctttactaatttggttttttttaatatattcacgctgaaattcaaccattttttgatagtaattttttgaaaaaaatggaataattccttgataaattagctccaaagaacgtttatccagaacaattttgcattccttaaccggataaaaaacaaaaaaaccattatctgctttgtttttcaaggcgttttgatcaagataaaaatcaattcctcttaattttaaggcaatattgaaattataaaaattatgatcgccattaaaactaaaaattatttctttttggagaaggttgttattttcaactatttcagctaagcttttcccttttttaattacatatccggttaaccgtggggaaaaaattttccaaaaactaggaacaagtcaatagccatcaacaaaatgattaattttaactttttgaaaattgtttaaaaaactggctaaattagtcataacattttgctaaaaactcgggaatgccgtcttgatcattagatttagtaataaaagtcgctacttcttttaaactttgatcagcttgacccatcgcgactgaatatttggcaattgcaaacattggcaaatcgtttttggcatccccaaaaactatactgcggtcaaggttaagttgataattttgggctaaaaattttagaccctcacctttattagaaccctgagacataatatcgattactttttcttgggattgcacaaggtagatatcctcaattttttcaagttcagaacttgctttttgaaataacttaggatcagaatcaattttgataagcaaaaattttaccacatcaagcttttcaagttctttttttgttaattcctgatagtcataaaaggtaagtggtaatttttcggccttagaaaaatttttattctgcgatcttaaataagtaaatcaagaacttttttgatttttcttagaaaaagcaagcatttttgttgttgtatagactagaaaaactacttgatattttaaaagaatctcaaaaatttttccaaccttttcagggagaaaggtcttcttgaaaactacttcattttttttaaaatcgtaaatcagtgagccattgcaactaattactggatagtcaggtttgacttgataataatattttttaataaaatatcacggtcttcctgagcaaaaaataaattttttaggcttttcaaggccttgaagtcaatcaatgaaggcttttgttcgaaggctgatttcatgatctgaagttagtaaggtcccatcaagatcaaaaacgatattatcaatctgagctagtttatgaagatctttggggataatttgactactttttttgtccataataggcgttttttccgtgtttgcgctcataatgttttttttggagaataggatttgcttggttttggtaaggattaatcacttttgtataaaaagccattttggctacttcttcgaaagtcatagcaagtttaactgcatcctcagcagatttatttgaccaacaaaaaggaccatgttctttgactaaaacagctggagttccgatataatcaagcttgtttttttgaaagtgatcgaggataacaagcccggtattatgttcatattcaccttgaatttgttgatctgttagtgaatttgtacaaggaattgaaccatagaaattatctgcatgggttgtgcctaaggctggaatgtcttttccggcttgggctcaagccactgcaaagggcgaatgggtatggacgatggcttgaattcgtgaatcggctttgtagatcagtgaatgcgtgggagtatcacttgaagggtttagattagtttcaaggacattattttcaagatcaacaggaaccatatctgaaaactgcattttttcataaggaattccgctgggttttataacataataactgcgatctttgctaattgctgagacatttccccaggtatgaagtgctaatttggacctataaagtaaaagatttgcttctaagacagctttttggagttcttcaagttcgttacggtctttaattttcattagctaacctcaacttttcttgaaaaaattcacgggctgaacgaattatttcaacctgtttttgaaaattttgctcaaattcagcattttggtcaaaattttctggtttatgtcacatttcaattacaaatgggacattaatttctgcatttataatgtatttaaaagcagaaacaaaatcaacatcaccttggccaaaatcaagatttttgaaggtatcaggcaaggtatctttaaaatgaaaagcaataatttcacttttgccgagcttaatctcgacttcaagatcattggaaaaacgcgataaatttccaagatcgggatataaaaatactccgccaccgactgacttttgcaaatataaaagtcttgtgattgtcccggcgaattttctatccattgactcaaatgctattattatactatatttttttgctaatgcaacaatttttttcattgttttgatgaaaaaaatttccgaatttggatggggttcctcataataaatatcataagcggcaagttggataattgaaattccgagtttttttgctaaaattaaggctttttccataatttttagcgctttttcgcggatttttgcacttgcagaaccaaaaggaaactttcgatgtaaggacaaacacattgaatttatataaaaatcatgttcgattagagtatctaaaattactttaatctcatcattggaaaaatcaaggcgagaagcaaactcatctgtttcatcaactgacatttcgataaaattaaaaccagcttctttggcgattctaattttatcgattaacgaaaaacgtttatcaattgctttttcgtagataccgacaaaaaaattaggttcagtactttttaaactcatccttgaattcctttgcttttgcctctggatcttttgcatcacgaattgaacggccggcgataaaaatataaattgggatatccttaaataatttaatatcctcaacttcaaccccgccggtgattgtaaccttaaaacctaaattagcaagttttttgacaatatcaatatctttttgggctcattttaccccggaagcttgcgaatcacgtggtctgtgtcagactacttgcggaactcctacttcttttcagtcagatacttgatctcaagcaaaattatttgtcatttcgacttgaatttcagtggttttgccatttttttggtaatatttttttgaaagatcaactaaatccttaattgtcgctgtttcggctgcacaaattacagtggtaaaatcagcgcctgcttcgaaaaacattttcccgaaaatatttccggcatccgcaattttaccatctgctactatgattttatcaggaaatgcttttcttaattccgaaattgcttttttaccttccgaagctaacaaaattgttccaacttcgataatatcaatgtacttttctgccttttttgccgactcgattgcctcctgaatactctgattgtcaagggcgatttgcaagagcgggactgccatttctctccttttcacgatttttttgttggtttttgtgatagtaattatacactaaaattgaatttttccaagaaaaaaattcaaaaaaattcggaaatttctttgcgaattttgcagggaaaatgaccaaaaaattaattaaaaatcaggcctaaattctctaaaaaagtccaattttttttaaaaattggtaaaaaattgccttgttttggcaatttttcaaaattttaactaaattttagctagtcacacaacgtagttttggctatattttttaaaaaaaacaagagaaaacggggttataagcagaaaaattatttcttatttgttttaacttcaactggtaaaccttctaaattagaaccaagttggggaaaaagcgaggaatcaataactatttttgaaaaagcactgcttcgttttgcgactttaaggaaattaatcagatcggatttagccgcctcagaataatttccatttaaaactaaagttgcattttgaacttgtttaccggatttatcttttaactcaattatggaaaattcatgaggtccaaaatttaaccttttaccaaactgaccatcaaagtcttctagtttaaccgtgtattttttctcggagctagaattagttgaatcagtctgggaatcttcatcaattccaaatgaaagattcttgaatttaaggtaaaaatttgcttgctctttaattccggtatcagtttcccaagttgaaatttcatcattaaaatatttatttgtcccatcgaagtcaataccttttagagttttaatacttgttttactaaaatctaaatttggcggataaccacctcgcccgccaaaatatccctggaaaactcgttggttgatttttgaaccaaaggcaatttttagaccttcgttaattttgtttggatctgattgatctttggatcaagttagagtatcaaaacggattgaaccaggcaattttagggcgggattataaagttttatattgggtttatcaacataatctcatttaacaaaatcgacattttttagcgcatttggattaattgctcaggctccatcgtcattttgacgatttgaataaagggataattctaataatttatgattttcaagttttgataaagctaaaagtccttcaggatcttcgacaaaaagccgtagggaaagaattttttttggtaattttgcaattatactttcaattgttgaagaatattcacctttgacattttcaaagacaacctcttttagatcttgttgggttttttcaagactttcaagaattgaagaaaatttggaaagcgcatttgaatcggaagcatcaaggactagcgaagaaaaactattataatttccttgaaccgggaggttattttctttttctttttgatactggataagtttgatcccggaagaaacaccttgggattgaaatgatttaacttgttccgaatttgcatctaaaactgttttagtccatccctggcgtcttagcgaacttaatactgttgagtcattattttctcaggaactaccataaggagcgataccactggcattgtttttaattactgatcttctataccagtcgtttttaggaatccaaccatccgagtcgggatcaggactataaccttgctctaaaaatccgaattcaatttgatcaagttcacctctttggagacgagcaagtcggttattatgatgttttaaatcttggttttggcgatctagttggtgttgttcaagggaaatttcatagttaataattttatctcagtcttttcccttatggattttctcgtctcaataaaccgatttttctttttgctcacgttgaaaatttagatcttcgatatgttgttcaatccgatttttttcggtagtacgtgcactaatattatatcgtgttctttgaatcagagtttggattgccgaaccatattttcccgaaagatcaacgcgttgatattcatctttttttgggataggagcgttttgtcttggtcttgtaattattggctcttcttttggtagtaccgtttgtgctcctgctggggctggttgatttttgcttaagtcagatttgggcggattaggtaggatagtgggggctataattattgcagcggtttcgtttttttttgatttggatttttcttcaaggtttatctctggttttagatcagtttttttaacagtcgggatttcgggaatataaactggttttttttcagtttctgaaggtggagttggttttggggcttcaggtacttccttttttggaggaggctggatataatcggtattagcgactggggaaaaattatctgtatttgggttattttttaaaataatcgaaggagaaattgtaagatactgaattccgtatttgctttgataatcttgtttataataagctcctgaagttccaattgccgataacaaaagtccaaaagttagtgaaattaagatcagccttttccgtcgcgttagataaatagccattttcttccttaaaatttaaagtaaaataaattatagcaaaaaaaaaaaaaaaaaaaagaagtaaaaatttaaaaatttattctagaataaattcaaggggaatctcgcctttgatcgtttgtctttgaaagtttgaaaattggagactttgactatttggttctaaatatgcatttggctctaaatgtgcatattcaagatcaaaactatataataattttttatctttaatttccatttgcattttattggcgtttttatataattctgttcatttaagcgagattatttgtggataggcaaaaaagttattattgactttgatatatttatttacctgaaattccttaaggatgatatcagaatcattattttttagacggaaaactaaattatccagtaaaatttttccaatttgccctttttggatctcagttagactctgaccattttgattctcgcggaaaatttttttatcacgaatttggggccaaataaggtttggatcaatttggaattcaaagtcagaatctccatttttcttaagattttcaaaagtaaattcctcgggttggccgatattttgctttgtctcttcagtttttgttttttgaactttaagttttagtatcccagtttgatcatttgcacttgcgctaagaatatcaaaagatcatttttcgagatcctttgcattttttagacctaaaaattcagttttaagaccaacggaaagtgaaacctgagaaaatgcagcactaaaatcactaaaaactggaagattaaaataggattgcttcccagaatttacaagtgcataagctaaaattgaaggactaattttcgaaaaaaccggtgaaagttgttttttatataagatagcttctgttttttctagttttgatccttggtctaagtttcaaaaaaggacaacatcttttgttaattttagatccattcctttttttagtaatgaaagttggacattttcaagtttatgttcgtttatattacttgaagaatcgacttttttaacttctcaagggaagttaaaaattatttgataattattatcatcgaaattttcgagtttttttataaaatttgtatagtgaaaagttgatggtttttctttgagacgatataaaagtgttgtaatgttattattagaaaattttttttcggttggagatagttctaaaaaatcaggaattttagcaaattccttctctaattcttgtttatcttgtagaatttttttattttcctttagtagagcatcttgtttttcttttgcttgcttggatttttcaagttcaaagctaattttttcaagtgcaagtttttccttttcaaggacaagtttttcttgttctgcttttctaagttcttgttcctgtttttgtttttgctcttcaaaattgtccttttggatctctagtttttgatcggctaaattatgttttaattggtcgattttttgatcaactatttcttctttttttataatttctttagtttttgtttttattttgataatatcctggacttgttttggctttttactaacctcaaattctccaagatcaacttgttctttcttattttcttggaatttacttgagcttgtttgatctgaactagatacctgaccagatttatttaatagattctggttatttctggtttggctggattttgctatcacttgttctaaatttggattttcctgagtttcccagtttgatggcgaaaattcactttttagtgaatatgaatatgcagaaatcgccgtaaatcggtgttttttacccgtaaaaccttaatttttattaattacaattaattacaattttaaagtaattttatggtataattataaattatgaaaaagcataatttgattttgtttaatgtttgaggatcttcaaaagataaaatatataaatatgttggctgaacacaaggttatgggaaagctccaaaacgttgatttagtataggaaatgtgcaaactttggaaaaaattaatccaaatgctattcaaattatcaaagaaaaattgaaattattttcaaatttagatgacaaagataaaatcaagacaactttacttgattctattaaaaattccgccataatcgaaggttcggtttttattggtggggaattaattgaaaaacttattgaaaagcacaatatttttgaatcacttcctaaaagtagacataaaaatatgagacaaatttttaactacttaatttcaaagcgaattactgatcctggtagcattattaatgcttttgataaaaaggatgattactcaaatcaaataaatacttccaaaaatagcttttatagactcttagatcttgtctatgaatcacaaaatcaacttttagatagtcttaacaaaatggttataagcgagcttggaaaaagggacaatgaattttattttgattcatcaacagtctattttgagacatttgaaagaaatggattaggaattcctggctattctaaagatgctaaattcaaagaagatcaaattgtcattgctttagcatgcgataaaaatggcattccttttcatattaaagtttttaaaggaaatacagccgattctagtaccctaatcccttttgtattagatattgaatctaaatataatatcaaaaatatgacaataattgctgaccgtggcatgtccactgctgcaaatattcgatttcttgaatcaaaagaatataatttcattatttcttatcgtgcaaagataggcagtcaaaaatttaaaaattatttattagatcctagcgattatgttgatctaaatacagattttaagtataaaaaagaagaattttattcatcttataaaaataaaagatacactgaaaatattagaagaagaattattacttacagtagaaaaagagcaataaaagacagcaaggctcgcgaagagcaaatccaaagttttattaaaaaacaaaataaagatggttttattgaagtaaacaaattgtttggtaaaaaacctaaatattttagggaaatttcaaacatgaaatttgaattagatcaaagtaaaattgacaaggacaaacaatttgatggttactatgtctatgaaacaaatatactaaatttaaatgtcttagacatagttgaaaaataccaaaaacagtgaaatattgaagctaattttagaagtctaaaaggtttattgaatattcgtcctgtatttttaagaatagatgagcatatcctagctcatacatttttgtgctttatctcattagttattttaaaaactataatttttaaaatcaacaaacatattagtgataacaagttatttgcaaacagtcaattaactgaagttggtttagtaacgatgttgcaaaaattaagacaaagggttgaatttaacactttagatcaacaaatgatatttaaaaatcgcgatggtgttcctagcgatcccaatatttgaaataggtatgatttctactttgatatcttaataaatcagtaaaaaaataggtaattaacttttggcaaaaaacttaaaaaagcgcgggaaaccggacacttttttaaaattatctcatcaaactgggaaactcgggttctaaatttggattttttgttgttaaatcctcaggctttttacaagctgcggcaacaaaaaacaacgggataaacaaaagaattatccctaaaagtcaaaatttaaaactaaatctcccgacttttgctttcatcatcccaccccttaaatttcgtagatgaaattataacataaattttttgttctacaagaaaaattctaaatttttttggagcacggcaaatccgagttttttttgatcgctttacgtaaactaataaaaaaatcaaaatctcaaaatttagtactaagattttgatttttataaaatttttgtcaaattttttcaaaaattatttttgacttgaaggttgatcctcgctctgtggcggctgattttgataataaaatctgataatttcactagctagatcaaccttaccatcacggaataaaatcccaattgttaactggctcgataaattattttggtcataataaagttttttctgattatcggataagacaatcatctggttcataaaaactagttcaccattttcattaaataccccagaacctgaggctcctggcccattagcagtaaaaaatcttggcatcccattaacaacataaacacctttaaaaatatttttactaaaagcaagttgcggtcaaaaaccagcaattttggtgctatagtcaatatctccatcctttcagattctaccattaatttttaaaggactaaatgtttttgcataatcccagaattcttcaaaagttttaaattgttcgcgaaaaaagagaattggactatcaattgtagcaccattagcaaaacggaatgttgagattaaagattctttatgtcgatcatagaaagcaagaacatctttgatatcttgacgaaatagtccgtggttaaaataaaacattcctatatcacggccataattattaaatccttgagctagtctaaaccaacgattatggagattaatactaaaattaattatttcttcttgacttgcatccctaattgggatatttcttttttcaccttcagtaaaatttcctttagtctgaagttcgtgaacagtgcgatcatattcagattttattcagaaaagggataaaagcccggaaaatccaagagaagatagatcatttaccttatcattataataaaaccgcataaaaggataacccattctttctcagaatgggcgcccattataatataaaacatgagcgtttgttaagaatagactctcaccatctttattatctagtaaaattgccgttcctggggaaaaacgaatattacgttgaaaagtttgttgatatttttgatctgtataatcaagtgatttaaagccgatataatttagtgggaaataacgctggcgaaaatcttcattataataactatgataagcaatttttgctaaatcgttatttgttacattctcttttttgattttatcaaataagtaaatatttagatcttcgtttttttgacctaaaaacatattttcgttttcttgtttgattccctcaggggatccaagataaaaagattggtaaatacttggaaaattaccaaaactagaatcaaaaccaactttttgaacaactttttgatcaggactacttaattcctcaaccttaaattcattttgtgatttttggttaattttgcgaaattcctcttcatcttggagattaattaacgaatcctgcccgcctagtaatgaattaagacctgaaaaatcaagtttttctcctaatgaagtattattactaggattttcaattaaattatcaactgcaattgtgtcttttgacttaccagaattatcagattctggactttttggagcagcatcaagtaaatccgcgccccttagcatcggattatttaaaggattttctagatccccttcgtgattaaaaggtttttttgaaaaatcgagattctcatctgccttatttttttcggattcagggttttctttttttgtgcttggtaaagttaaattatccccatctttgcgaggttggttttgaggttggttttgaggttggttttgaggttggttttcttgcttcttggttgtaatctctgtcttatcgtagcaagaaagaacacccaagggcaaaaaagacacaatcaatcaataaaagaaacgtcaaattttcatgatccacccccgacttaaaataacttggctatgtatgctggcattataccatagataaattaaaaaccaaaaaaaattttttctaaaaaagaaattaactacctatcaaaaccaaaaaactagttctagctagtttttcggaattagtattatttttacctatggtattttttgtccacctgtgtttctcgctttttgtttttaattctgtacttatcgtaggaagaaagaacactcgagggctaaaaagacaaaatcaatcaataaaaaaacgttaaatttttatgatccacctgcgacttaaattaaaataacttagatatgtatgttggcattataccatagataaattaaaaaacaaaaaaagtttttctaaaagactaaaactattattaatcacctatcaaatccaaaaaactatttctagctagttttttgattaggttatttcgtttactagatttactatatagttaaaacaagcttaatttgatatttgcaaattgtgctggaagcaattgcgttctgtggattattttgagcttgtttttcggtgattttgggtgcactattggttttttttttttttttttttttcgttgttccctgggttatgaaattgccacccgttattggtctttgtactgatacttggttgttatctcctagtgagtgttccgactttgtttttgtttacttattttgttttttattgatcgctttttatgttttcttgtgctgagaacgcattccctaatgattggcacctgcttctcgtcctacttactcgtctccatcatcgtcgtagtaatccgatagttctgggggattgactgggttaaagacttggtaataattgtctggactatataggaatggtagatagttgctcccttctttgactaggagtgctactggtcatcgttcgttttttacccctgttcacttaatcttggggccgcgagttctgccgtcgtttattaattcactcttgcctaccttgagcttattttttgcttttccattgatataaattgctgctatttttcttgtcgttgttacaagagattctccatggtaatcgaacatataacctgaggttgttttggttgggtttttagcatttaggtatcaggtatcgtttcttagctcgtccttaaaggcaaactcgaaccccggtgctgatcagaagagctcttcgtttattttggttcggtttattacccaggactccgggattagttttgcttcttcttctctccacttgttgtttcattctactccatttgtgggtagtgatatcgcatcatgggggtttgcgtgatgcgtttggggcattacaaagcctgggaggtttggtgtggggttttctgcattgatcgatattgcacttgcgatagtgttttctgacttttgtttaatccttagcctgatagggagtttagatattgaatttggtttgaaggcgatttttttacccatcagacttgtgggaagcctatatttgccttggtcgacgttaatatttcaatatagggttacgtatcttatttttttatctttttctggggttggctctttctgtttacggcttgttctaatcgctacgggtgggcctgttatttgaatttcttcgatcttacctgcaagatttggtagtctttgatcccactctttacccttggcttgttgttctttgggttcttgttctgttttatcccagagcacctcaagtcaatcttgatccctatatggggttaggtctgcgaactctccatatggatttcattcggatccagtcggcattatctgatctaaaggatcatatactgcataggtaaatcccattagtcctggcattatataatcaatatgcattggtgttactgttgcaattgtggtagaagactgaaaggaaatacttgaacctggtatttgggattgttgggtttgcagttgttgttgggaggattgaaaggacccatccacggtcattgggttggagttaaatttttcggggtttttgatctctacggttatgctggctccgattagggtttttagggtatatggctggaggtcagccgaggctatttggagttcggggtttcaatttcattcttttagcaccgcttttccatttatttccgttccgtttatctttaccttgaggttgttttgtaatcatttcggtcctattgtcgttactgcttctggattaaactggactttgactttttcacctctgtaaaccttatatgaaattggtatcgttcaccctcttattaactgtgggcgtatattttgaggggcaaatagtatttcgacgctgcggccgtgttttgtgttttggtctatgccctccagggttatatctttgatattttttaacatcgtttcatttaacttaagctctttttgttcgtctaattggtggtttggaatgtcttgcctgtttttgggtaaaattttaactattttatatatacttccggattcaagatttgaaagagcaaaggttagctttgaatttgctaggttaacaccaaccggttcagattcaagctcttgctcgttataagcaagattgtattttggtcctacttttttatattttaagatcattgggatcccttgtaatgattttgcatcttgaacacccattgtaacctcaattattacttgggttggggatactggagttattttaaccggattagatctacttaggtttaaatatttagctgttgtccgaaactctctttcgtttttacgacccccattaattattaaattatcgaattctactttaaggttattctgtagtgatttaattttttgtgcctggctacttttttttagaattaaatttatatctgtgtactttgtaaatttaataaggtccttttcctgagccttgaatttgtttttcttcccttcttgttgctgtcattcgatcgtccttgtataactttgactttccccttctttttttacttggagttctgtatcaaaacctgcttttgtaagatcatcagttcagccctctaatgtaactgttgctgtatcatcctcaggatctgtagttacctttgtaattaaaggctcggtaataaattcaagatcgacggttttttgacttgtcgatctttttttacgtctggtttgatttcttttccaccccttgactaaatcaacttcacctttgtgggtatttttatcaactgttaaatttactgttttggatgtaagtgcttttattgtataccaaattccaggtctaagagtattatcaaacttgaatgttgcttttagttctttttggccatttgatggggctgaaataaatgttgttgagcctattgattttacttgttgtcctgattctgaattttcaagatataaggtgattgtctccccttttaaaaaagcatcatcttcggcaaatgtaagttcaatatctgcagaattagttgttacatttgtaattgtcgatgaagtaagatttgctttatctgctcttgaataaaaacgtctttggattgcactttcatcttttattggatcatcaaaagttaattgtctaccaccattattaattcttttaattatatattctttaccttttttaattgtagattttacttgaaaatttattgtattatttttcttaccatcttttctttcccctaccttatttctagatgttgttctcattgcttctttgttttttagttttcaagattcagggatatatttattaccaaagttttcatctatttctgaactaagggtaagtcgttttccatcaagaagaccgttgttattaaaaagttcaacaaaaacatttgtctgaccttcacggattgcttcatatttaattgatttgattgcattttcggttaaaaggttataattagttctttttggttttgcccttaaattctgcggcaggctaacggcaaatttgtcggccatttctggttttaaagtaaaaatataattcttgattgtatatctatccccaggagttaaatttttagcttccagttggactttgattgtactactacttttactatctttaatttcgactgtatttgtataaaaaacatccttatcaactgattcaagctcaagttgaattttatatttatcttttaaaaatcctagatcttttttggcaaattcaacttcaaatcaaccttgtctgagctcggcctttctattttggttttcttgcctactattttttgttacagccatttgatctgttgttgaagtttttacattctcaattgaggctgactcaattgatgtattaataattgttggccatttttcggctgtatcggtttttaatttattactatctttttcccagtcagccttatcaataaataagtcaaaatcaccttgttggccatttacattttttagtttaacactatcaattaaataccaacttcctttatcaaggcctgtaagttcaacttcaagacgagttagggttgaatcatcattttttgactttgttattagtatttgttcgttttttacctcttttgcactaacttggagttcagaagaagtcttagccattttatcaataggatcactagggttttgccagccatattcttgatatttattttttaattttttatattttatttccatttttgaattttcaaaagttaatttttgtgagttttcaacatcaaaaattaactttattgaattctcgcgggctacataagctagtttggtaattaaaggggccgtgttaaaattaaatgaaggagtattttgtgggcttgaagaagaaaaaagtgaagtagtaatcccattttcattaggtacatttattctaattttttgttggggatctaaaagcccgattacttgatactttgcccctggatcaagtccttcaaggtcaaattcataatagaaattagcctgatctgggagattattcttccagctttgctgttcagttctaaactgatcggcactaaaaatttgagcctcaacttctttctgccctgttgttgatattccgtattttgatgattggtagacaagttttagttttgtttgtttgtcttttagaggtttatcttctgaaccaaaaaagactctaacttttgctttattccatggggttggactagaatttgatcgatcaggttgatagatcaccccaagggcgtttgccgataaaaaatcggttttgaattttttaacttcttgagccgaactaggttgactacttaattgacttgctttggcagtttcaagaacctttatatcattaaattcgatgttttggggggtttttagctgactttgatttccttgatcttctttttcaaattcgattttattaattgtataatcacttgctttagcaagtccttttaaaaggaaaactgcttttgaagtttttccaatctcatccccgacaatttcagcacttgcactagtctcagaatttgaagaacttacttgactattttcaagcttaaaacttccttttacttttttcccgatataagatccataaggatcgtcaattacaatttcaattgttgcagtagtttccccgatatatttttttctaattgatacaacttgggagtttgtataaaatgatcgctgcgaaattgtaattgattctttaatgcttacaggaggaagctcaagatgggaaattgctttgatagttttagttttttcatcaaggaatttaatatgatcgattatatattttcctggctgagaaatgtttttgatttcaacttcaacttttgggttctgcccattttgtttttgaagggttgcagttatattgtttttatcaatttggacttcttcaaaaagaccttttggatttttatagacattgccattttattataaacctctaaaaatccttggtatttcttagcaaattcaagtacaactttggctgaatctttcttaaaatcgggtttgatctcgattttatcaacttcaactttatccgggaaagtaataaatgctctttttggattagcttgttgactaaagcggaaaaatcctgatgtatctgaatttatctgttgagcttcttctttttgaattacactgtcaacattagtttggtcataggcgattttttcaatataatactgggcaaaaagatcaagatctttaagggtaaatttaaaagtagttgaattttcaagactactttgatcggatttagctgaagaacttgtactttgaggtctttgggctaattttttaatttcagcttcaacttcttcaatagttgccttagcgtttttcccaccgacaacttttttatattgaattttagcttttaaagaagttttatttttaaatacttccccaccatctttaagactaaaaataaaatcatattgatttggatttagcccattacgaaactgctgaattgaattaataattggaagagttgcaaactggcgggcatcatttttgactttagcaccatcaaagtagaaattaattttttgaatccctgaagtcgtagttgatcttcttaatcttcttgcagaatttagttcatttttgagcccaacaatatgaaagccatttccgccttgaagcgatctaagctcagctttaaatttaatttcatttgagctttgactatcctggcttaattcaacctctttttcttgagaatcaccgacttgataatagacaagttttaatttatttttataatcattatgttttagatattgatcttttgcatcaaaggttagcgtaattgttgcctgatcattttttttatcatctttttcaatttttataattttagcactttcaggataaattataaaatttgacccaaaggcgattttcccgttattggtgatctcgccttcaatttttgaatgggtttttgtatcaatttctttgattgcaaaatcagaaaaattagggttattttggctagtagaattttgattttttacagttggatcgactttgtttgtttgtgaaccattttgctgactttcagaatcagctcaggtaagtgattctaacttataagttgcatttttttcaagatcactaaattcaaaactaattttggaattattggcttttgctgaaaattcaagatcacgactctggggattatttgttccatcgccagctaatattttcttaagtctaatttttatatctctgtcttcaaatccaccggcttcaattcctcttccagcaaggggatcgacaatatcaaagttagcaatataagttgtctcgtcttttttagtaattgaataagaaatcacttcgggcttggttgcaaaatataattttgaaagtaccttagggggattttcctcttttttctttttagatccagcatcttcatcatcgaatttaaaaattcttagttttttaggcccttgtccatcacttacatcttcaattttgacaagcagatataatgccccggcctcaagttgggaagaagcatctaatctaagatctagttgtggatttgtattttgactagaacctgtagtaaattctttttcaatacttacttgctttccggtaattgaatgtttaaatgtaaatcttaatttgcgtttcttaccatgtttttcctttgtcaggaaagtttcttttttatcgaatttaatttgaatatccgctgaattattatctgattgataagctatatcaacaattgttgccgattcagcttcaagttcaaagtttttgatgattttggtttgggacttttgatgactagaaaacccttcaatttcattaccacttgcattacttgcagttatttgctcttggggttgttctgctacttttgcttcagtaattttataactagcggctttttggagcccgttaatttcaaaaatagcaagtccgtttataatctgggcggtataaaccttattttggttagaattaggaagctgggctccgttttcgccttctagtttaatttgaagatattttgaatttcaatttgcccctttatcatttaatttaattgtaattcttgctgaagtctctgaagtagactctgggctaatctcggcaagattaggggtaggtgagaaaaattgtttttcaaatcctgcttgggtattcggggatttatcaaattcgaatttaaattcatttttcttaagattttgttggtttcgaactgaaactgtttcattttttagttttaaagactcaatttcgtatttatccccgggatttaaattgttaagggaaaaactaattgttttattattgacatcaactttggcttcttgtattgaaactgaagattttgttgataaattattataagttaattcaatatctttttggcctaaataatcatctaaattatcaaaagttaatttaatagttagactatttgttgttattgattcatattcgattttattgattttggcagtctgggcgcttgtaataaatgttttttttggctcaagatttttactttcgacttcaaaaagttcaatttcttcttcttggacttgctcagcttggacattgacaaaaacggcattaaattcggatatatttgatctaaaaggattctggctagctaaaagtgaacgggcttttcttacttttggctgatttgcttgtttttcaaattttactgatttaattttatattttgcaagcttatcaagattgataaaagtaaaattataaattccattaagggagacttgctcaagtcttaggtttgaatttgatccatttgaattttgaacttgcccattttcgccgatcttttcaatttcaagtgtgacttttttcccggcggtataccttccgccatcttttagttcaagatgaaccttggcttgacgctcaactgaagtatcaatttctaattttttaataaccgctgaagtagcaattatttgatctttataaaaatcaagatcatcaagataaatattaacttttggatgctttggatcgtcttgttttacttgttcaaaacctaaaatgatatattgttgtccattttcaagatttttaagtttaaaattagttttttgggatactatatttgtctctgcttgaacgatttgttcttgactttcaccgccgaattttttatatctaacttttagtttttgactatctaagaaatcatcaagtttttctgtattttgactgtctttgttatttgttctaagaaaatcacggccgaattcaatttcgaattctgcttcattttttgttctttttgtcagattaagacttgttatattagctgtttttgggattgtagaaaactgttttttctcatttgtagcaagtaattttgctttaaaagggattgttttggcttgagtctgacttgtctggaaggttgagacttgatttgggctagttaaagaaagcgatctttttgccctttttgggctagcagaaggtgtatcaagaatttctaaagaattttcatttatttcataaattccttgtttataaagatcggtaatatcaaatctaattctagcaccaacaattggggcggtgatctccccttgttttgcttgggctgaacttgctttttgtctatcaccgtttttttcaactaaggtatatttaagtttggcagtttttccattatattcgcctttggcatcagcaagaataaaggttgcgatcaccctttgttcataagaattatcataaccgacttcaataattgcgcttttggtataaaaatattgttgcttagcatcaaatttatttgtaaaatcaccaaaaagcatattcctttcaattatctcttcctcgccattaagaccaagaattttgcgggctaaaacaatcgaattaatattatattttgatccaatctctaaatttgaaagactaaattctaaagtattttgattattatcttttgcgccttgtgaattttgtccaatttttgtagtagttgataataattttgatgatcctgcaagggaataataaagttttacctcattatttccaattgccttataagtttcaggggtaaaatcaactttaagtttggcacttgtttgttcttcttgcaggttgttaattgattttataactaaaggagcatgaactccaaaaattctttgggcctgactaattgtttttgaaactggaagaatatcatttgaaccttttgaagatttataattatcaatctcgattgcttcaatttgatagtcaagtcctttttcaagattttcaattaaaagcgaggaaataaccgtatttgactcaatttgggccttaattgtttttgtagtgccccctggttttaattctttatatttaattgttgctgattttaaaggttcaagggcgtttttaattgcaatatttaaggcaatttcagtctcagattttttaatataagtaattgaagatattgccggacgagttgtccaatttagttggtcagcataaatattaggcccaaaatttagatataatttattaacaaattcttgattattatcagcaatcccaattgagtcaataaaataattagttcctggttctaaattaattagatctcaggcaagtacaagtttatttcctgagatattaaaagcacgggcctcggatttaattagattagttgatccggcaactttaaaatataaagttgcaattttatctttgataaaatcatcagctgaatctagaacaacgctaattcgacttgaatcttcactgattttatcaattgtaattccctcaatttgggcactagttgcatgggtaaaaaattttttttcttttggatcgaaattttttgaaaaaaagattgtacttgttggttgttgactactttcttggtcaaaattagtaatattacctaaaatctcaaaggaagcaattgtaaaatgtttttctttttcaagatttttggcaaatgaaagcattttattcccgataacctgaccaactgttgaaagcatcttagagggtttatcatcggcaaaaaaattaatttttatatcttttccattaagtaaaagactttgatcgttgaatttaacatcaaaactagaagtattattgccatcaacaaaagttttaattcgggcaacctcaggggaagaaataaaccagagttttttatcaacacgaaaggaaagactaccagaattattccagattcttgaaattcagaatttagccccaccaggaatatcgcttagatcaagattggcataaacttttgatccttgaatgattagatcaacatcatttgcaagtccaaattggtaattatcactctcatcttttcaataatattcaagatttattttttcattattattaagttttactttttttgaatcaagaactaaactaatctcaacaagggcggaattaagtccataagctttttggcttaaactttcaattttccctgaaatcggacttggtctaaaaaaccgattggctaaaggcgagatttcaagatcaaaaagcgaatttggattatcaaaataatattttagatcaacaatttcatagttttgaccgcggacaagattattaaaactaaataaggcgttttttcttttatcccctttgatttgtccattagctgttaaaatcttatttgttcctacttgtttataataaaggattaaattcgcttcttctaaaagattttgactatcttcaaggtcaagatctaaaattgttgtattatcaagatcataataactaaatttttcaacttgatttttcgttgagaaaaactgggaagtttttagaaaactaaaataataacgcggattattcgggcttacaagttgaacttgataaatcgaaccgggtaagagactatcaatataagtcgaaaaattatctaattcttgattatagactatttttgattttacctgatattttgatttttgattaatatagacaagttcaagatcagcatttttagcccaagatgtatcagcctgattttttccttgaagtttaaaactaaattcacctgttgctgcctgaatattattaccaacaaattcagtgacataaatagtttttggacttagtaattttgcaagataaggggatagagctataattgatccggttataaatccagatgcagctagtaatttcttatttagatatgaatttagttttttatcatttcttacttcgtttttctttgccattttcttcctttcaagttaatttactattgagatatacccgtccaaaaaatcgtgttgctaaaccctattttttggtttttaattatgctttggctttaggttatactgttattacttttcatatgtcttctcttcggacccaggttatgacatatggtgtttccgcgtcaactgtcatgctgttatcgttatacattggtagtatgtatttgtggttgttgatctctttatagtatttgtcttttgtatatttggtgtgcgttttctgtcgtagtcaggggttttggtttgggttaggtggtaggtgtggaaagactaggattccgaggaatttgagttgctcgcctggttttgggctatgtaaagggtcggttgacgaactttgtaacttaagtttgattgttatttttccgttggttaattgctgggaaaagtcagcatctcgccataatattattggtaagccgatttcatttcgtattagatacatatcaccttggttatttataaatcaaccatacatgacagaaggcattacttcttggacgaatttaacttgttggccttggttggtttttgtatataaaccaacggtcattgtctttgaattttggtcgtattggacatcataaataccaaagggtttttggctcatttgcttttgcttttggctggtttggagttgtatatttctatctacctctggttcttgaccgtttgcgctggtttttttaactctagatgatgggcctatgaatattgtattatctcagtttattccggtgagtctatctaatttggaactaaacgtgtttgatctagataaccctcgagcttggttagtaaatatatttcctcagaatggatctgttttatctacttggggatatgtagcccctgtaaggaaaaccttgggttcgtttcagggtgtaaggatttgattttggtagtagtttttgattgcttctgttgtttgaaaaccgattctatatcggtggctttttgagttatccctgtggttttggggttgcttgtatgttatgaatcatcctaattcgacctcgtttggatttgatttgcgcttttttgtagttctctgttttgtttcccattgccttgctcagtttaccttggttttactcttttcctcgtttttggttcattttactttcttttcaattttatttactagttcacttcattttttatttgggtctgtgagtaacgaggaaaattcgttattaattttgtagcctgatcaacttaatgttaaactaacatttgatttgtttgattcgggtccaagactttggacggcttgattatagttactttggtccgctatacttttactgatgttttcttcgaatttatccctgataaaatccgctttaactttattttggttttttcttaccttgcgtggatcatagagttttgcttttattttgatccccactcctgatacaatctcggaactggtttctcttataaatgctacgttggttttttgttttcagttctcaatttttattaatgttccattactgtagactcttattgggaatctggagtccttgcgtttatctttttcgttactctctgctgagggcatagtgattctttcttcttccgtcacggggttggtttgttgttgggactgactggcgctttgattttccgtttgatgatcatatcagcttgttggtgttgatggtgagcttctatcgggtttccggaaataatatgctcttaactctagactaatagattcattttcaattcagctaccatctcctttaagggttcatttaaagtaacgatagggtgacgggtcgaggattggggatttcggagtaactgatgttgtttgggggccactattgttagaggaaaaaacctgattggattttttagatttcaactgatagtaataggggattttgttcattccgcccatctcctttaataagcggtttatgtcttctgactctgttatgtatacatttttattattatttcctaatactttggtttgctctattttgttttggtgttcaacgttttggttaattgtttcatgggggtttatatagggtatgtattcattattagttacttcggcaactctatcgatccttcatttttctgttgattgtggactgtcgagcgttttgagatattttttgactagtttattattattattattattattattattatatagagcaaagtttcattgttctagttttgtttcatctagtacttttcacgggtcataaaattttaatattagtgattgctctcaggtatcattacgcccttcgggatttgaaaaatctgtcattctaattgtatgaagatctggttcttcaatttgggttgtaaaagttaatttattactatcgttattttctaaatttagggaagggccattatttgattcaatttttgttataacatatttagttgatgctcttagttgctttcatctgttctttttggatcattctcctagatccgttacttttttatttgtaagcgaagccgttaacgtttttttggacctgtcaaattttaaagcaaacggtagggtaacttttttatctttttcatactgatcggctgactcaagtgtgatcattaaattttgttgcattttgttttggtcgccacttttatttaacgctcacatatatactggatccaagtcgatatcaatattttcttcattgtaattatctgtgtcctgctcgttttgtcaaagcccggctcagggttgctgtgttaatttaattttatcctgaggtagtttatcaaaaggcatttggaattctttttccttttgctggatattggagggttgtgttgtttgcatttgcttactaaagttgatccgcttattatttccgaaaggaatatcataaacccctcattttattttatcaatcttgtatttaaggaatggaattagtccattaaattgatatttgaccttaattgtatttccagttgaactttctaattggccaacctttgatattttttttgtctcaaaaggaagaaagctttttgcttctttatcagggtctggttctattgttataacaattggggttttttctagatctttaaatgcatttttatttcctacaagttcgacttcgagttcagcatctgtatcagaactagcagttacttttattactttgactactggcggaattcttacctgtttttctaatttaggtgtattggctagattatattggtttttagggaagtcaaccttaactttgatatttttctttttacttactagagatttaagcttgttattttctttaatttcaagttcgaattcgattttttgacccggttttagtttcctctgggcgcttttttcttttgttgtatcaagattaatctttaagacataaggtgttgctttgtttgtattatctgagctgacctgaaggttagttttttcaactaatacttgtgaacctgagacttggttatcaacctcttttattttgacatcgattttcgagctattaatccaggcatcattcttatcaaaataaagatttacatacccttttacttcttcaccttcttctggacctgaactactactactactactactactactactactatgactcgatgaacttcctgttcttacattaacttgtttaacatcggcaacaaaaattttctggattataggggtaaactcgctttttgtttggctaagtgatcttttacgtcttgttctcacttgtgtattcaaatcagggatctcaaccccaccaatttcaagttttttaatttcataggtctcaaatctatcaagatgttcaagacgaaattcaattactccctttttatttaccggctggaatttttccttagaagtaaatgaaatttcttttccattagagtttgcctctgaagattttacaacggtaattgttccatattcctttgggatttgtaaaaatctatcattaaatgaaaatttaattgttcctgaacgaccatcggcatcttcattttcatcctgagatcaatttacatcttcaagataattaaattttgctcttgtttcaaagaaaggtgctttgttattgatattaaatcttacaacttcggctgaatctacctttttaacctcttgaccccctgtacctaaaaaagaaggactagcttgattttgtatgtcaattgtatcaatttttagatcctgatttttatcacttaggggtttttgtaacccgtgagtgcttaggcttacttcaacatcttttattgtaaattttgtgattttataggcagtatttgcactaagatttaaagatgaattttgattggctagagtttcttttgaaattcgaacttttgaaattggaccttcagggacaaagacaaattttgtggtttggggttgttgttgttgttgttgttgttgttgttgttgttgttgttgttgttgttgttgggccaaatcaggatttgtccctttaacttcttggatttcaacctcgattttatgtttatttcgccaaagatattcatctttttcatcaaattggaaataaacagtagctgcttcatcttcataggctccgatttgtgaaaaattagtaagtcaagctttttttgccggggtagtaaattccgttttatccattctttcagttttataatcagaaatatcaattttttcacctttataaaaataagcttgaatttcatataaagaagctttatttaaattagtttcaaaactaattacatataaatgcgactgaccttgtttttcatctagcttttcgatttttgcagctgggaaattatttctaatttgtttagagttttattatataattgtactttaaagtgttttttgtcctgatcttgttcttttagatcttctgaagaaataaatcaagcataaattttggtctcaatccctgaagttttatctttttcctcagtagaaataatttgatcgtaaactctaattgggattccctcaattatttgtttttgacttattggtgtttgtggtattaagccttgaggatttttaaattcggcttgggtattaaacgatttattaaaatcgattaaattagatactgaagtagaccttctttttcttgatctttctgagacttctggttttcctattagttcaactttttcgattttatatttaaatccttcaaagattttattttggcctatctgtttttcttctgtttttgaacttgaagtttttggatcattaacttgattaataagggtatttgtttctttttcaattggatttgttcgagtatctagttgttttagactaagttgcttttgctgggattgtcctgtattatcatagatatcctcaagtttgacttgtattgttccatcagattggattttcccttcaactactgacattggagtattagaatttgttttatcttgtcttttataagaaactttgactttataaccttcaagatatgaagccgattgctcatctaattggatttttacataaacaacgctgttttccttatctaataaagttctttgaatatcaactactgaaaaacttgcaggggtagttcggaataatttatcttgaaaagttatactatcatcatcaaaattaattacttgttcagatttcccgttattttcatagacaacagagactaattgataataattaagcggttttagatcactggctgaaaaagtatattcaccacttgaagaatttggctgttgttgacccccttgatctttaagttcggctgttttttcttggccagatgttatatcaatgtattttaattttatttttcttttattttggcttactttttcaagtaatttcgttgtatttaatttgattttaatttcagcattattccctgaaagattaactttttcaatatttacaacataagcggcagtatcaaaagtttttattagtgtatttgtttgttgcttatcttgactaagggggtctaattttagactaacagccgcaaaattattacttgtatttgtgcttggtgctggactaggttgggttgcaaactcacttacttgataatttagagcactactaaaaagacttagatccctttttttacggctaggagcttgtggtgagtcttgagatgcacttagcgagcttgtagatcgattttgatcggttccaatatattttgcaagcgggaaatgttttattattgcctgatttgtattagtctgagggagaaattccattttggtaatttcatatctagtaccagaaggtactttatttttaatttgatctttttgaatatcaaaaattgcaagtccatcttcttttactactgcctcagcagtaagctgggcatcctcagatccattatccccttgttttttaaaactgattttaattttattatttactaaaaaccagtttttatttacatcaaaaaccattcggataaccgctccgtgtttgcgatattcggtctgtgatattgactctggaagtacttcttttgcagttgtatggaatttcttttggtcctgagttaaatttctaagaaatccaactggaacaccacttacaaaaatatcaacaattgaatacaaactatatttttctaaattttcaaaggaaaatttcgctgttgcttcctctccctgataagagatttgtgcctgagcttgaaaaattgccccggttctttgggatttaatcattaaatgaatttgacttgcctgtccttgttttgacttaccatttgaataggcttcaaaaaactttttcgggtctttaattttaatttcaatcccagcggatgtatcagataaattagtattactaatctcaattttttgaggaggattactttgggtatttttaattaaatccttattgattgtaattgaggaaattaaagattttgtaaagaaatcttttttcattggagtttctactttttgttgatcaaattcgactttaaggtttttaaattcgttttcgggagtgcttctttttgatcttgtagaccttgttataggtttttttgtaatttctaaatttttaactgtatatccagtggcctcgccaagattttcaatttgaaaacttgcttgattattttcaattgctacttttgaagtttttgtactattttgcccgccactattctgtttatttttaagttcatattcgagtgtggcttcaaaatcgttattaagtgatccatcttcaagggagtcaaaaaaagttgtaagtaaaacgcttgtcgggcttagatcagaatatttgatatcaacaactttaattgaactaagtttggttttaaactgcgtttttgaagtatcatttttaattgtttttgcaaaggggatttggtagatcccattagttcttacaactgatagtgaactaatttcatattcagtaaatttatcaagattatttttaaattcaaaagtagcacttgctgcaccggaattttcttgaacttttgcacttgctaaaactaccttaccggtttttttatttcttagggttagagttgtaacttggttattatttagttttaaaatttcattatttgaatttgaaaaggttattttaattgttgctgatctttgaagatcttgttgaccttggccttggccttgattatgcccgcccctggtttgactaggattaaattcgacattcgaaattactatatcagtggcaaatttaagtgttttttgttttgcttgatcgttaatttcgccgatttgtctttgttgacctttgattatcgcgcttgtaaattcattgacgatctcgaattttgggcctgtattttgatattccttatttgtaaaaattgcattcttattaattattttaagccctttgatcttaaaatcggttccttcttttagatgatcaaaattaaggctggcaacaagacgaccatcgccttgcctgatgatttttacttttttagtctgattggtttgcccttcttgcgcaatgactgtagaaacgctttgaaattgagccttaggttctttatcttcgattatttcaacttcgatttcttgattttcaagatagccatcgcggattggatcaaaatagatctcggctttaaccccatctgatttaatatcagaatagacaagatttttaacttcgattttatcaacatttacattaaatgattttttattttcaagttcgtgattaacccagatacttgaatcaacttgagaataatcattaattgatacaagaatatatttttgatttcgatcaagatttttaaaatcaaattcggcagaaattagtccgctttcgtttttagcagtccctgttgcagtaataattgcatttgttttttcatttttcattaacaaggttagctgttttgaattttgtatcaaaatttgttctgcgtctttaaaggaaagttttactttaacttgctcgcttttatttgattgaacctcaaatttaaaaagttcaggggctgaataaatttttgcctgactatcacttgatgtaattcctggggcataagattgagctttaatttcaaagcctactgaggtttgaatatttttatctttggttagattgctaatcttttcaatttcatattcacttccgggttgggtattctcaaaatttagttttaaaactaatttttcatcaacatttccggttgcctcaattgtttttgcatcttgattttgattttttggttttagcatcactttgatttgatcattttttaaatagatatctttgacgggatcaaaagttaattcaaggccgattttattatgttttttctcgaactggacaatttttactacacttgctgttgttgcaactgtataaaaattacgctcaggggctttttcatcttttaatttaggagcaaaatttattctttgggaatcaagaagtagttctgtaattgtataatgacttaatttttcaagattttttagatcaaattcggctgtatttgtattattagagaattttattgtagttttttcagaagcggcagccccatttgcattattttttaagaaaataattgcatttttatctgatttatttggtcttttgccaaaatttggatctttgatattaaaatcaattataatttttgcactatcttgttggggttgacttttaattgattgaatctgggggattgtataaaaataagggggttcgccttgagttttattagaatcttcttctaatttattattaagatattcataatttagctctgttagccctgaatcttggcctggggctgactcaagtccggcaaattcgtatttttttccaggataaagatttgatagactaactttaattgcattattaactacctgaatgtattcagggtttttattttctagttcttgactttgaacggttttagattcttcttgcttttcctttccttttttatcttctttttctcttttatctgtaacagcttttatattattgcctacttgatttggataggaaactattttattattttcgtctttaaatttgactttgaatttataattatttaaataactattaaaagttggatcaaaataaattgttgcaattgcgctagtttcacttatattatcaaaattagaaccaaaaatcttaatctttttataactagtactaaattttgcattttgttcaagaattcctgatgaactaaaaaattcagcaagttcaggaatctcaagatcgacaacttgatattcggtttttggatctaaattttcaagattaaaatggagaattaatttattatcactaaggatatattcttttttctctgggcctggagttccgcttgcttgatttgttggggcaagatcgactttgattgtgctagaaagattaccaaaaccgggttgaccaaaaacgagtttggcactaaattcatttttggccccggttttaccaactgaatttttaaaatccccttcaagacttacagcaacttttgcacttgtctctgttatttgatcaaatttaatttctgagacacgatatttgatgaaaaattcatcataaggtaatttttgtgcacttgattttcctaaatcaaattggattgctacggctagatctggtttttcggcaatctcaattttggctagtttataaacagaagatacttcaaaatcctcaagatcaaatttgatctcagaaccttcggctttagcaacctttgatttatataatttagcaggattatcttttttataataatataaataaagatttttatcatttaaataagcagactcagggaggaaaccaaaggtatattcaactttacttgccaaaatttttggctctaatttaataaaagttttaagatcggaaattgttgtaataaaatttctttttggtgagctgatctctaaatttttatttcaaagaaaaagaatatttttatagtcatatccatctttttgcaaactaaaaactgaatttggcacctttgaaattaataaaagtttatcaagggcatattttgtatcatttacaagacctttggctttaaaactgattttatagatcccattttcttgtccctgaaaaaatgtagcacttgttgggataattgagctatcatctaaatataaaagtgcttgtgccccttcaagattatcagctgaggcaattgttagatcgacattagcaaaagtagctccaattgcaatttttgaatcaattactgctgctggggtataaaaatttttaataaaagtattaccaaattcgatctgggcaccttcaagttcaaaactttcgatctggtaagtacgacctggatctaaattatttagatcaaaactagcaagatcggcagaataaattgcactaactacataagtctgacttgttttaagatctttatagtgcattttaattattttattttgtaattcctgggtggattcaaaactatcaaaattaatatttagccttttttgggaaaaagataaattttggtcaattaacgatttagttactaatttgaatttagcagttttggtttcaaataaacgttttttggtactatctttttcaaaatcgatttttggatcaagggcaattttctgcatcggtgaaaggggaatttcttgccgattatttgtatcaacataacgaattgcgctgatcttataatcaagtccggggtgtaaattatttagggcaaattcaacttttccgtctttaacaattccggcatcaacataagaagtatggatttcttgggcggttttagcattttcaagttggctttcaagatcatctgcttgattttttaggacataataatattcaagggcgacttttttcccttctagatttgctgcctcatcggcaaatttaactgatactgaagctgtagaaggagttctggcctcaaaattgattgttgatacagcaggaggagtatcaacaaaatttgtcacattttgtccaaagccaatcactttttttgccgaaaatcttttctgttttttatcatcaagataaacttttagatagtaacgacgcccaaaactgagattgctatatttagaatttattcttcaataacgactaaattcatcatatatggcagtataagtagctacaacctcttttccttctttatcttttgtaagatcaacatttaaatcctgataatttagtttaaaagaatcaagatcactaagggcaaactcaatctcgtaattgatattatcttgatttatatgtctaaaatcgacaatgttgtactgaagtgtatttcaggacttaagaaggaaagggagaaaaccaaaagaaccaacactaaggccaccaaaggctaaaagtgaaagaataatcgcacgtctttttgactttttcatcgctttttttgattttttgtcattgatatcatccatttttcacctcttttttcagtttaaaatttataaatttttgttatttatgaattttcctagattatattaaaaaaagaatagacgttaaacaaacgctattgtttcttcaaaaaaaatatagataggctaaataaaaaataactagatttattgatagttttaaatgatatacagtaattatactatattttttaaaacttaaaagaaatttttcaaaaaaaattttttaggaaaaattaacggtatttttacttaaataaggataatttttaattttttgaaataaagttgttttaaaattagaataatcttaaaaaataaaaataatttcattttttaagattattctaataattcctgtaattttgataaattattcttgttttttgcagatattaataagcaatttagttttaattttttacattgatttagtaatattgctcgggttgactgattagttttatcgattttattggctagaatatgaagtttgaaaccttgtttgatgatatattcaatcataatataatcaagattggtaaaaccaactcgggcatcaagaatcaaaaaaacagcggaaattggctgatctttttggaaatatcccgcaattattcggtcaatttggtctttttttgtctttgatacggctgcataaccataaccaggaaggtcaacaaataatttttcactttcatttttatagaaatttagcaactgtgtccgccctggttttgttgatgttttagcaatttttttattcgctaaagcgttaattagagttgattttccgacatttgagcgaccaataaaggcaaattgtggatcagaataacaattttctgggcatgatctaagaaattttcacactttttccccgtttttgacctttaaaaatcaagaaattaaccaaaaaaataatttacattttaccataaattaaataaaaaagctaatacttacttaaaaattttccaatttttttatgttttttattaatttaattgcttcctaactaaataaatttagattttttggtctgatttcctaataagttttgacttaatacgagattttttacttataaatattaatggggaaaattttctgcttttctaattgttgatttaactctaaaattactgcattaaattgacaactatttgctgaaatccgaaatcttgcatttttttgatagcgaatttttttatagacatcaagaaaactcacaccaattgcatcatttgctggtccggtcatcccgacatctgtgataaataaggttcccagtgctaattttcgggcatctgcagtttggacatgagtatgagtgcctaaaagtgcattaattttcccgttaaggtagattgccaaggtatttttttcactagtagtctcagcatgaaaatcaactatatgaaaatcagctttatcctgggcaagaacttgatcgattgcatcaaaaaaattatcggcaaactgatgattccaaggcttgactagtttattaaaagcaactccaagaagtgaggtaatccggaaggttttgccgtttttttcaattaccgttgagccatttccttgatattcgggggcaatatttaagggtctgactatatcggcgttgttaataattaggttgatttctggatttgatcagacatgattgccgactgtaaaaatatcaacccctaatttttttaaatataaatagtcttttttattaagaccttttctgccagtgatattttcagcctggacaattacaagatcaaattgatatttttgttttaagagttcaagttgttctttaaaaatttcaattccaggggcaccaaaaatatcaccaacgaataatacagtagcagatttcatcttgggctaaactttttacctttgcaaattaagtaaaaagatgccgatttttagcatcttttggtcaaaatggtatggtgccaacaacaggaattgaacctgcgaccccatccttaccatggatgtgctctaccgactgagctatgatggcaaaataatattaacattataacatttttttaattttttccaaataaaaaaatgctttttttaaagtagttaatcatttagaaaaagttttaattttaaatttttagataatccttaattttttcaaccatatcaagcttttctcagggaagatcgagctcatcacgaccaaaatgaccataaactgctaaatttcggtagattggtttcctcaaattaagccgagaaattaaactaactagacgaagattaaatacgtttttaataatttcaataatttttaccgttggaattttagcattttttaggtaagtaacattaattagttctggatattcattaccgattgcataagcaaattgtagctcgatttcggcagctactccggcggcgacaagattttttgctattcaccgggcaatataagcgccacttcggtcaacttttgtataatcttttccactaaaggcgccccctccatgttttgcagcatccccataagtatcaattatgagttttcgccccgtaagccctgtatcaccaattggtcctccaattgtaaaatcaccggatttgttaacttttttttcaaagtcaatatttaaattatatttttttgctgctggaatcataattttgttaattacaaattcaacaaaattatgatagttaaaattctgctgatgttggattgacataagcatacttttaacttttggtttactgttttgatcatagtgaatctcaacttgggatttcatatccgcacaggcaaattgaaattcacctattttccggagttcttcagcttttttaactaaaaagttagccaaattttgtgctaagggcataaaatttgggcactcgttagtggcaaaaccataaacaatcccttgatcgccagcaccgattgtaccgtttttctgatcgacaagggaagctatctcgccggattggcgatttacattggaaattattgtaaaatcattttcgttataaccaatttcaaataaaatctctcaagcaatttttacaagatcgacataaccacttgttgagatttctcccccaattataattaggcggtttgatgccattgtttcaacggcaactcgtgcgtgctcatcctgtttaagaatttcatcaagaatagcatcgctaatttgatcacaaattttatcaggatgaccttttccgactgattcagcaacagaaattttcgctgctaacatttacttcccttcaaattttcattatattataccattttttttaaaaaaatgaaaaaattttttagaaaaaatttttgcgcagggttttattaggaattttttgctttttgggctaaaaactcttcaaaactaagggatttatgtcgttttgttgtcaattttccgtttttaagcttgataattaaatcggctaaggcctccattgctggatcatgtgagaccataacgattgtggttttgtattttttgttgatatatttcaaggcgcgtaagacaatattggtattagtttcatcaagggcgccagtaggttcatcagcaaaaattactttggcattcttaacaagagcacggagaatcgagattctttgttgctgtcccccagacatctgcgatgggaatttgaacttgatatcatcaagttcaaattcggcaaaaagttgctcaatatcaagtacttttgacttatccttttgaagataggcgccaacttggacattatcataaccgttaatgtttcccaaaaggttataagactgaaaaataaaggagacattttggcgcctaaatttggtaagttctccgtttttaagataggcaagattgactgaatcaacgataatttccccttcagttgctcgatctagtcctgacattaagttaagaattgttgactttcccgatcctgattttccactaagaattgcaaaatcaccagcggcaatactaaaattaatatccgcaaaaactttggtaacaactgatccaaaaagataatattttgctacatttttaaagtcaataattgcgcctggcgagtttgtcttatcaatatttccgctcttaactcggggattatcattggctcaacggattaatttaagctgtttttttgttagatttgcttgatttgtatctttgataatcgccagggcttggttttgtttttctactttttttgttttggaaaatatattatacacgattttctcctttttgttgtaaaaaaattaaaaatttttttgtacaattttttctggtctaaaaaagaaaaaattggttttttttagctgttttttgaaaaaatttaatttttaggttttatccttgattatataaactgattttttgcttgtaagaaagtatcaaagaaaacttaaaacgaaaatgaaaacaactaaaatgattccaaaagcaaggaaaaaggtcgaaattgaaagtccaagcgataaaaatattgaatttgtaaggagaatataggaattaaaaatctccatcgcaataatgacaaacggaattgaaatcagcgatgaaatcagcagaatcggtaaataaatactataaaataggcgcactttcgttttattagcataacctaaaacatctaaaatcgcaatgttttgctgattttcgttaataattgaagaggcaataatcactaaaataattaaggaaacaacaagaaaaataataacaacaatattaattcccgctccaaataagttagcaaaattggaaataaagttagtttcaatattttttgcctcaagaccggtaagtccaatttggtagattgtctcgccataaatttcattaaaattttttagtgctttcttgatttccggaatattctgatttacaaaagaagggttagtaagcgaggcaaaatcaagggctgaagacgaatttagtcaaggtttttcttgattttttttatcaaaattaatcagatcaagaatttcttgctttgtatagccagcaatttggagcgcgcctttggttttatcagtttcattttcactaaaagcgaaaatgtttgcaaaaaaaccgatggtatcatctttgtttaactgatcaacactaattttggaactaccagcccaatatcctgaaggtgaatacaagctaaaagatttgctgatctgttcaatttccgggtttgaaagaattataccattaaatggcgataaattataattttttagaatattttcaaattgatcaagtcctaaaagtttgttagcgatggcctgtgaggttataagttcggagtttatatatgtatcggaaatgccaataattacaaatttagctttcttttgcggtagttttttgattttattataataacgatcaacgtgattaagaattgggacttcgattctagacccaattcctaaattatgtttttttgcaaaaacataattgattatcaaagggtaaatttcatcttttattgggtatttttcaatttctgctaataaattattattatatttatcttttatctcaattattgaatttttttcagtttttggattatagccataaattttgatactactttcggtattatttttagcgccataaaaactgtcaatataagtataaacttgattttttggcagattttcattagcgttttcactaaattcaatcccggcaaaactgatggtaaagtcttttgccacttgattatttaaataggaatcaactaaaaatttgcgataggcatcacggttattactttgaccaaaaattgagacttcataggcgcgatattcgtttttatcttgatcaaattgataataccaaaaacgaccttgatttggatcagaagaatcaactagatatttaaaatacggctgtttttgcttgattttttcaggaatattctgcactttttcaatctggtggacaactttatttgaaattgcaaaaatgttattccttaaagattcaggaagatttgctaaaacgatatcaaaaattgaggctttatttgcctgatttactttaatatttagacttgaacgcgaaatgacaaccggatttctactttctgaatcaaccaagccgtttttggaattaatcccaaaaacgcttggatttccgggacggaaataattaggggagttataattaacttcagtattttccccggcgggaacataaagatttttcccaagatcttttgcattataaacaacaagtgggcccccttcttttgttggcgaaaagaggttgattttataagcataatgccggttttgataggtttttttaatactattttggaaaatattataagaagataaagaaaaaatcaagacaaattggacaatgacgattgcaataattaatgaaattatttttcaaattgaattaattacaagtgaaattgaaaatttattaacaattttgctttttcagaatagttttgcgaccttttgggcaaattttgaggtattaatttcgttgatccctgaaagtaaatgataaggtttttgtcttaggttccaaaaaattaccaaataaattagtactgagataacaaaaaaaggaataattagcgaaaaaacaaaagaaatgggctcaaaattataaatattaatatcaaattctcagaactgtgaaattagattataaagtgggatttttccaaaaaatccggataaaaagcctaaactaccgcctaaaaacgcaattataaagccaattgaaagaaacgaagaggcaatttcaaaaagtgaatatccttgagcacgcagaattcctaggaccttattatttgttgaaatataccgtttgataataaaagcgattgcaaataggactaaaattgacaaaaagaggcttaaataaatattagtttttgaaaaagtttcaataatatttgttccaacttgaattcttagggctctttcggggtttaaatgatcgatttcgttagtaaaaaaagtgtgctgggaactattagaggcaaaatttttggcaataaaactgtcaatatcagcccgaaatttttccctgtttgtaccaggcttaagccggattaggaaataatttttaattggatttgattgataagaaaatcttgccttatcaaatccgaatttatttacataggctagcacctgattttgtccatcaagtttgacgtttttctcatcaattacaggatataaataatcaatactaaaatcagtgccaacaattatgtattttagaccgccagcatttaaaatgtattttggatcaagaagttcaattaatttttcaatatcactagctgaatcaggaattttgccttgatatacttcttttttatttttttcaaggtaagatttattaactttgactacataaccgcttgcattattaagattaattgaattatttgccaggcgggcaacaattattttcgaaaaaaattgatcatagaatttagctacattaatcccaaaaaattcgggattttctttgcctttttcgctaagaaaatccgaaattgagcgcagacgataataatcaagtgaaacctcattaacatttttattaaaccaaaacgggggaatataatttttatttggtctgcggttgactaataatttgataaattcagtacttttatttgaagaatcacttacaatttgactaatttttggcagacgattttggagaataaaggcaagattaaaattgttttgaccttcttcgctcttagcttcaggatttgttgtaaatcagagtggaatttgaacaagttgggcagcaaaaaattgactaagaccaagagattcaagatttagacctgaaagtaaaggattaatagaagcaaattcctgaacaagtaaagaaagaaaacgttttttaaaggctgaatctgaaaattttggattaagcaaaaaattttccattatatattttagggccttatcaaaacgggcctcaaaaggataattttgggaataatagctaataaatcctaaattttcgactaaatcggcaagattatcttcaagtcaggattttagtgaagtttttctattaaaatcatcgatataacttttagcaaaaactggatcggctaaaagttcttgaaattgggggtttttttctagataaagacttaaaagataaggttgaagaattgcccttgaaggtttagggagtcctaaaaatagaccttcttgatcttttagattaggtattttagctaataattcggtattatttagctcatttttgagtcattctgatttagttgcctgaaataatttatgaaaagccttggataaatccagattttcaagtttattttcggaaacaaaacgaattcaaaaacgcaaggtttttattactaattgagtaattatttccggattttggataatatttttctcaagtttgttaatttcggcttcagaggcaagaatataaattggttttaattttaaattaagggaattagggcccaaatcttcactaattttttcaggaattctaattgcatttaaaatataatagaaaatatcgccaattgagccagtatttgcaaaaatattatcactttcaagacttggaggtttaatattactaatttgattcccagttttttggtaattttctagacgaaatagtcgatagatttccttgatctggaaaagtttttgcctaatatcctctaaattctcaagattttggattgttaaatatttatttaggaatatacgttgctttaaatttaaatcactaatttttaaattcggattttgttctattttttcaaggatttcctctgagacaagatcaattcgagtatttctaatccctaaatcgggactagtggatgacgaatttcaatttgcagcaagaaattgaagatcgtagatatcaatttttctaggatcagattcaggaaaaaaataggaaaaaccaagttgactagcttcagaactcttaccttttcccgaagcatttaacattttaattaacgaatttattgttttctggcgggatgagtcgctgcgaaaaaaagtcgaaattagagcaattatataatcatttgggctaagacttgaccgttttgcgaataaattatttttttctttttgtttttcttgatcacttaattctaaaaatttgtcataaccataagaataaggtgtttttcttagaaaaatcaaattttctttaaaactttttaggtcaaaattggtaattaactcgtttaatccttcattaatatttgaataagctagttcattttcttgttttccgtttagtttttcaagaatttttatgacttgattttgatggtttttagcaaatttttcaataattggttttgctaaaaatccaaaaaaacctttggttttctcatcaactgctgcagagaaaatgcgagcaaaatcaatttcattaactatttcaatcaaagcggattttaacatttgctcatcaatggatccaagaagtgcatcaacaagatcactggaagtaaaaatatttaccaaatttttattattctgatttttattatcagaaaatcagttattaagatattggaaaaatttttcaaaatcaagggcataaataatttttttaacacccttaagtaaatttattggatctctaatcgcttttgcaagcgcctcaggggaggcatatttttgaatatcatcaaaaatgcgaattccaccaagaagaagggccggatttagggcataaatttgctttataaaaaaaagacttttttcataatttgtcttgccagaattttctgtttccttaattatctggtcaaaaaaattacctaaaatatcattaattagtgttggtctgtttgtttttagtaaaatattaccagctctagtaattagatcgattactaaattataatttttgattcgataggagagaatatcaacaagtctaatttcttcagcagccttggcaaaagcattaattactagatcaacatcgggttttaagaagaaatttttatcaactaaaaccgagttattaattgcatttgcaatctggataaataatgaactagcactattttgggtttcaatttcgttttggacgttagtagaaaaataataaaaaattaagggaattgttgcaatatttgaataattatcaacttgtttggttcagccatctttaccaatttttgcatcaatttcaaaattattattttcaagaaaattagcaagcaagctcaaaacgcgttgctgagaagaaaccgggtttatatttgtatcaactttaatcaaattttcgggtaataaacttcagtgatactgaccaaaatttttaaaaatataaccaaattgattattaggtaaggcaattatcccgtgcaaatcggcttttgggagaatattaaatcctaaatcgggcttattagttttaattttttttagtctaacaatttttatattacgataataatcataatttagtgatttattatgtttgaattcaacatcgccaaagtcaactttaagatcgacataattaggatcaattccgtagttatcaaaaacattagcaataatttttgcctgaaaaattggtggaatttttcctaattctgcactagaaacttttgcattctgagaaaataaacggcttttcttagcgttattttgatcactaatctcttgaaaaagtcgacctatctgctgctcttggatataatcctgattttgaaaattaattttattaaaaattcttggactaattccggaattaataaaatgaattacttgttttgcacttgcattctccgttttttgctggacatcaattgtaaaagtttgtcttgtaccgatgccatcaacgactttttcttcttttcccttaattttttgggaataattttgcagatgttggtaaaaatataaattagcatattcctgaacattttgtgctagacggagaaaagttgcattttttatattcgaatttgaaatattatttaattcttcatttgtaacaagtgctagattatttttattaagtttttgaatctcggcgattgaagttcttaataaacttgaatctccttgtttataaaaaggaatgctaagatcggtgattgaaagatcagaagagacaacattttcagagctaccatctattgttctaattcttttttctcagtagttaatattttctaattctttaaattttttgggataatttgcctttaaataaattaaatattccttaataaaaccagaaaaattttgaccttttgagtcaatttcttttaatttataacggtgatttatatactcaattttggtttttaaattacgaattcactctttttctaatttataaatttgacctggatcaagaattaaaaatgaactagattctcaaattagattatttactaaattaaactgatcagatctaatctgcatttggattccatcagatccctttttaaaattaataaaactatttgaattttgcaagtcggcaaattcaaattcaccattttctttttggtaaatatttaaaagtggtaataaatcctgggtttttagctcatagccgattccttgtttttttcaggaagcccctaaaattggatcaaaggttgcaacttttgttttcccattaattacaagcggattaatagagctaataataatttccttaccttggtgaaaaaatacaaggatatcgcttggtttataattttttgtatcgagactgattatttcattttttcgaatttggtatgtttctaattttttacggaaattttttttatcatttgtaatataaatcggaaaaaatgcttgttttgttaattcaaaactatcattttttcctaataattttccattaaggtaaaactctcgggaaaactccccagaggaaatatattcattttctttggttttatcacctaaaatttgagataaactgatataattactattaattattaattgttttttttcttgatttgtatttaaaggtaagtaaatttctggctcaagatagtcatatccattattttgggcattaccaaaatagttaaattcggtactaattgttgcatcctgaagacctgaggtttccttatattgatcaagtcggctaacataagcacggtttgtggtaaataaggcggtaaaaattgcggcagtaaaaaaaactaaagttattaggccgataaaaataactttggtttttaaaaacatcgcaaatatatgtttaaaaatctttttcataatatggcgccaaaccctaaatgctatataattataaaggaaaatttaaaaaaaccaaggaaattttgctgattctcaaactaaaaaagagaatttttttggctaattaactcttatttttttaattttgtggtataattacattacaaaattatccaaaaaaaaaatgtttttatattaattggagtagaaatgattgaagttttgtatataaaatcgcatctaaattatgaatcaacttgtaataaagtagcggatctttttattggtgaattaaaaaggttaaatcctagaataaaaattagtgaatttgaccttaataatgaaaaagtgggaaaaatttcgctaaattcagaaaatttttcccacttttgacaagatgttaatgctgatttttgaattgaaaaactaaaaaatgttcaaaaagtaatcatctcatcgccaataattaactggggatattcagctcagattaaaaatttttttgatgcaatctgtcttgcggatcgtactttttcttataaatatgcaaaaaaaggtggatcagttggcctacttaacaatcttgaaaatgtacaaattattttaagtgctcattcaaaacaagctgattttgtaagtccaagtccggctgagacaatttcaggaacctttaatttccttggtgcccaaaaaattaatccagctttaattatagaagaatcacataaatataaaaatgcaaattttgataaaaatttgcttgataatatcaaaaaagcagcggaaaatttctaaaaatggagaaaaaatgaatattcttgtgataaagtcatctgttaatgaaaaaaaaggttcttattcttcgcatttatccgatctttttattaaattttacctcgaaattcatcctgatgatcaaattgaagtctacgatttaaatcagtttgggctagcaaatacaaatcttactatgaaaaattttgaggataaaactttttatcaaaaagctgaatctgatttttgaattaacaagttaagaaatgctgataaaattgttttttcaacctcaatgacaaattttaattattcagcgaccactaaaaacttttttgatgcaattacggtgccaaacaaaacctttttacttgataaaaacaccggaaaatataccggattattaaaaaatattcaaaatgtacaaattctaacagcccaaggagccccgcttggttggtatccttttggaaatcatagcgccttaattaaacaaatttttgaatttcttggcgcaaatgttagatcagatttttttgttcttgatggtacaaaggtagctccaaataaccagaaaccaattgctgattttgtagcccaaagacaaaatcagataaaaattttagcagaaaatttttaaaatatttacaaaaatatagtataatttaataactttttacttacaaaggaagtataaaatgaaaaaaaatattcacccggttcaacgcgagctacttcttagttgctcaacatgcaattccgaatttagaattaaatcggttatcgaaaagtttacaattgatatctgttctggatgtcatccccaatttacgggtgatcgttcactcaatcggacaacagggagaatcgagagatttcgtcgtatggcagcaaaagcgcataaaaaaacaaaaaaataagaaaaaaacaactaagaatgataaaaacactagagcaattacagtcaagtttaactattttttatacaaatgttaaaaattttcattgaaatctccaggataaagactttttggtgcttcataaatttagtgataaattagcccaaaaaaccaataattttattgataatattgcagaaaagctccgatcatttggaaaaattgcgcttgctaattttgaagaaattatccagaattctgattttgaattatttaagtcccaaatttgatgttctaatgaagtactagataaattagcagagcagattaaaaaaattcttgaaatttgcgggaaaattcaagaagatcgcgatgaagataaaattggttatttaatttatccgctaattgatgaaataattctttactatcacaaagaattatgaaaaatttatgctcaaaaatcaaattcttaattttatttgggatcaagaggatatccgcattgatattttagtagcaaaattagctaatttatcacgaaaagttgctcaagatttaattttagagaaaaaagtcttaataaataacaatttggttctcaaaaagaaccaaattgttaaaactggccaaaaaatcaagatttttaacgactataaaaggccaaaacctcaacttgagccagcagaaatagattttgaaattatctttcaagatcaaaatatgattctaataaacaaacccaaaaatttggttgttcaccctggtgttgggaactgaaaaaacacactcgtcaatggtctaatttctcattttgacagtcttgaacaacttgatcatatccggccaggaattgtccatcggctcgataaggatacaacaggcttacttttagttgctaaaaacgcaaaagctcatagtttttttgtcaacgaactcgcaaatcgacaaatcaaacgcttttataaagcaattgttattggaaaagttttacacaaatttatgaaaattaatttgccgattggccgggatttaaaaaatcctcttaaaaaaactattagtttttttaactcaaaaccggcgattacaaatgtcgaactaattaaacattttagctaccaaaatcaagatttcagcctggttaaatgtcaacttgaaaccgggcgaacccatcaaattcgcctgcatcttgctcatattggttatccaatatatggcgatccaatatatggcaaaaaaattgacgaacttggacaaagacttcatgcttacaaactagtttttaaagatcttaatggtctaagccgcgaatttgaggcagacttaccagaagaatttaatatagcttttgaacagaaagaattataatcttaaaacataaaaaaaacttttttcaaagtttttttctttcctttagaatactaactgctataaattatcaaaacgaatctttattgaggggcccattgaagctgaaactgttagatttttgaaataatttcctttaaccgtatttggttttagccgtttaattagtcttaaaagtgtattagcattttcaactagttggggtacttccatattagttttaccaattagcgagtggataattccgtatcgatctgcgcggtagtttgcttttccttttttaatttcggctactgccttttcaggattagggcttacagttccagtttttgggtttggcattagtccttttggccctaatttctttccataacgccctaaaattggcattaatttgggttcaacaacaattacatcaaaattaaaattatcaattttaagattttgttctaattctgctgttgagtaaataagatcagcaccagcctctagtgattttgcagcaacttctgaagaatcagttgccactaaaacccgaacagattttcccgttccatgaggaagaaccacggctccacggagttgctgatcagcttttcgtgtatcaagatttagacgaattgctaaatcaacagagccagaaaattttgtataggaagtttttttgactaattccatcgcctcttcgaggctgtaaaaacgatttttatccaccatttgtcgtgcctggagtaaatttcttgaaacttttttcattttattttcctccttgcttttggataaattcttcaattccctcaacctcaacgcccatttgcattgctgtaccataaactgttaaaatcgctttatcgagattttcggtatttaaatcaggtaatttatattccgctatctctcttaattggtcaaaagtaatttttcctactttttcagtttttgattttttagaacctgattcaattttggctgcctgcttaattttataagatgttgggctagtaaataactgaaattcaaaacttttgtccttaaaaacagttatttttaccggaaccggttcatctccgcgatttttagtttcatcattaaattttcgggtaaactctggcataacaatcccaagacctgcaagggctgggccaggttttgcttgcccggcattaaattgcaatttagcaacccggacaacatttttctttgccattttagaacaaccttctttcttttaaaatttagattttcttagtaacatttaacttcttttcaccaaatcaaaacttaaaaatttaacactaaatttcttttttaaactttgatttggtgctctcgacaagacttgaacttgcacccgtctccggattagaacctcaatctaacgtgtataccaatttcaccacgagagcattaatggcggatcagacaggatttgaacttgcgcgggcccgttgagacccctaatacgtttccaacatatcctcttcagccacttgagtactgatcctaaagttagtattaataatattatatcataaaagataaaaaattaaaaataactatttcacttttaaaactcccaaccatttttttttttttttttttttttttcttttttttttttttttttttttatcttagcttttttaaagtattattaataaattgtgatataatttataaggttaaagtttctctgaaacttttggtttaaattttgagttttgattttaaattgtaaataaaataataaataaaataaagaaaataaagaaaataaattaaataaaataaggaaaaaatgcgtcgatcttttaagtgggccctatctttgactccaattgttgcaggttcagttggaactacggtttattttgtctcgggaaattcagtttcaaatttaggcgaaataaaaacaagcagggaaaatgtacaaattcaaagtcaatttaagccattttctccttcagagaccaatggtttaaatcaaattcctgaaaaaccgatacaaaaacaggaagaaaaacaagctcctaaaattcaaaaagcaccaataattataccagaaaaattaattaaaaaaacagaaaacccagaaaaacttaaaccaacaacaattataatttctaataaacaagaacaaattataccacaagtcgctccaaaaccaaataaaaaccaaaaaattttaattaaggataaagaatttgaaggagaaaaaccaaaagaagttgtaaataatcaaaaaagtaaacctttaaaaattcaagaaaaaaacaacctgacctttcacttctaaataaaaaaactccagaagtcattgatcctaaagtaaaaaaagaagaagatgttgctattgtgatccctgaaaaaaacaaaaaagaaaaaaatattacaaaaccaaaacctcccgagccaaaaattttaggtaataaattaataaaaaacaaagaaaatacaaaaatttcaactgcaaaaacagatatagtaataaaaaaacctgaacaaaaccaggaaaaatataaagaaaaagtaataaaaccaccgattttaccggttttatctgctcaacctttagtgcaaaaatctcccaaagttgaaaaaccactagaaacaccagtaaatgaaaaaaaaaattaagactgaactaacaaaggaacaaaaacaagaaaaaattataaaagttccactaaaacaacaacaaattaaggaagaatcagaagaaaaaactaacaatcaagaaatccaaacgcctattgatcaaaatcaaaaacaagtagatacaatcctaaaaggaattcaagaagatcttaagatcctggcaaacccaccaataaataacgaatcgagccaaacaaaagccagttataatgcagccaaaaatcgtatttataactataaatttacagataaaaaacaatttgatttatttaaaaaaagttttcccaaaacgccgttgacagaacagcaagctaagtatatttttgatttttgggaaaataattatgctcaatttaatccctcaatggcaagaatgcaatcggctagaaatatgtgaagagctgaaattaaaaaagttttaaacataattccaaagccacaagttggcgctttcaatcgggcaagtggaggacaaacttttataattgatttaagaaataaaaatgatagtggttgggttcaagcgcaaaaataacctaatttttattttttttaaactatttatgctcaaaaaaaataaaaagtacttaaaaggacacaaaatttcttaatttgagccctaatattgttcatatttttttaattttgtaaaacattttttatgtctataagacaatattactccaaaaatcgtaaaaaaatcttaaaaagaacctattaaaactgttatttttgcattttatagtataatttaattctgaatttaaaggataaaataatttttttcaaaaaaacatcgtaatttaaaggattttttatggattttaaccaaaatactgccttggccgagagagagagagagagagagagagagagagagagagagagcaaggtgaacgtgctcttaaatcagaattttataatacatattttctaagagttgataaaaatctttcaattgatcaaatacaaaataattataccgacggaattattaatggaaatattctcgaatttaagttaaatattactaacttaaactcgactttatttcaggtaatcaaatatttatcccgtttgcgaatcaaaggaattccggttccaaaaaacattttcctaatttccctaatggaaaataaggcatttttttatgattcaagtgactttttagaacagattgaaattgtttatatcggtgcttcaagtactaataatttggatttttatacaaaaatcgagcctgtagaactaaatttagcccaccctgaagaacaagaaaaactaattttttacttaaaacagcaaaattttgtcaaaattaacatcgatgaaaattgcattgtcggctgagcgaaaaagttttttagtgaaaatcccgggaaaaataagcaagatttcatcggcgataataccggtttgacccgagttttaggcgagatcagaaccccaaatctttttaaaaactacataaatccttatcaaaaagattcaaacattcgttttgaatatttaatggatcagctaaattccaagatccagcagaaaaatttaggcgctttttatactccaaaaccttatgttttaaaagcttatgagcttctaagaaaagcgattgccgaaattccagcaggaaatgattatattattttagaccgttgcgccggaactggcaatcttgaaaagtgactaactaatgaagaactttcacatacgatcatttcgacttatgaatattatgaatacaaagttttacttgaaaaattaggagataaagtaagacatataatcccaccagttgaggatcaaaatacttttttgcaaggactggtaagtggagcaaatgccctaagttttgagtatattaataataaaattattaaagaatatgttgataacccaaaatgttcaataattatctttgaaaatccaccttatgtcgagccgactgcaattgagcagcaaaagctaaaaactgccaaagaatccagggaatcctgaaaaaataactatgttgtacaagaagcaaaaaaaattagccatttaaaaggagcggaatttaacgaacttgccaactattttatctgatcagcttttgaatattatatcagaaaaaaaggcgatgctttaattgtcttttcgccagtaaaatattttaagtggcagaatgtagctaactataaaatcggtggcggttttgggtttaacagaaaacattttcatgcaagtccaggatttgtgagcctaatttggtggaaatatgaaaaggcagaatttaatgaagtagatcttgaagtttttgatattgatcaagaaaaaaatgaaatttccttcattaaaacagtaaaaattaaaaaaactaaaaaaatgtttagtcaaactatttataaatgaaaaagcgaaaatcccgaaagagtcgtccctgaaaaaggactttcttgcgaatataacggtcgttttagcacaaaaactggcaaaagtttgtacggcccgccacaaaatttggacaatgatcattttattgcttatctaaggggggatgcttttactctagggcctgccacagtcgctttagtaagagcaaaaacttataacgaacatggtttttgattgcataaaaataattttttagtcggccttatcgcctttagtgccggaatttttaaaataatggatggtagatgagaaaatacctatcttgttaaatcaggggatggttttaaccggtttttacaagatctaaaaagcaaaaaacactataaattagaacgttttttgctttcaaacctattttttgtcagcctgagtctaactaatcatatcagaagtctagcccatccagatttaaataattcaactatttatttaaatgaattatgccttgatgatcttaatcaaaaagaaactttagctctaaaaagtcttagaaattatgattttgacgatcaagaaaaggaacttttagagatctgaaaaataattcttaaacaagcggcacaaaccaaaaattacgaaaaacactttaaatacggactttatcagatcgatgaagaactaaatacaaaaactttaatccctaaccggaaatcgaataaatatatttatgactatcctgaattaaatgggaatattgaaactttaaaggttaaattgaaaaaatattattttgataaaattgtaccaattttatttgaatatgagtttttaaaataagttataatataaataaaaaagctaaaatattaaaaattttaataaaattaaggttacaaacacagtttttatcttataaaaactaaaaaaagttaaattcaacacgtactttttttagtttttaagttataagttaaacaaaaagtagcttgaagatacaaaaaaatctttaggtttcttttttaaactaaaaaaatattttagaattagttttgctttgctaaaatatattcaactaaagacctaaccataacaccagttggggtatttttgacaaaagcagtcgcggcaatatccaaatgaataaacggtttatcttcgacaaactcagctagaaacattgcggcagaagaagaaccggctttgccggaaaaatcagtattttttaaatccgccacttttgaatcacggatattttgggcaaaatcctgatgaagaggcattcttcaaattagttctccggcttcttttgatgcctcgttaaagttctttcaaattttttcctcatttgcaaaagctccagtaaaggtttcccctaaagcaatacgaattgctcctgtcagagttgcaatcgaaataatttcacttgctttttcttgtctaatcgcataagtgattgcatctgctaaaatgagccgaccctcggcgtcagtattattaatctcaactgttttaccattcattgatcttcatactgcatcgggcgtatttgcatcgccattaagacggttatcggtaagtggtaaaacagcgacaacatttgctaagggattaaattgtgataaggcatcaattgcagctgcacagattatcgctcctgacatatcaattttcatatcattcatatacatgccagttttgatattataaccacctgaatcaaaagtaattcctttaccaataaaagcagttttatattgtgatcctggaagcccttcataagaaatcactactaatttagcatcataagttgatcctctattgaccgctaaaagcaggttcattcctaattttcgcacttcattttcgcctaaaaccttgaccgttaattttggatttaggttcattttcttctgaatctcgcttgcaagaaattcagaacttgccatattagggggcatattttggtaataacgggcataattgacgctgttattaattatttggtatttatcaattatcggttttagttcatctaaataacttgaaaccactaaaatatcacgatttttagctcgatttttagcataatcggctcttagcgagaagatatcagatctttgaaaagcaataacttcgattaaatatctcaagaaagaatttggaaatttatcaaaattaatttgcatatcacggggataatgacctaattttgcagcaattttgcgaaaacggttcggagttaattcttttgagcgggagcctaaattaatataagcctttttttgcccaagatactcggtaatagctaaatcttcttttatcaacattggaatttgcgaatcagaataagctggttcaatggttattcgattggattcaaatttatttgaatacttgataaaaatttcagaaaaatttttcatactaactttgatagtcctagtaatacattttaatagcaatgcagtaaataaaattataacacaaaaaagttaaaaaattagaaatatttttttaaaatattttttctaataaaaaagttaaacctatatttaaaaatataggtttagataaaaatagcttcaagataatggattttataatttaaattaactcatttttcctcataagttgttttgatattgctgctatttactaaagaattatgcaaatcatttgtttgataagtgatttttcaaccattttcttttaaagattcaattgagaattcaaaaaattttaaattatcagtttttaattttaaaataccatcttttactaataaattagcataaatttccaaaaaatctttgtaagtcaagcggcgtttgtaatgacgattttttggtcatggatcaggaaaagtaagccaaattgtgcttgcctttccttttatccggtctaataaatctttagcatcacttatgaggataaaaaaattacttaaattatatttttttacatattttattgctttaactgcggcagaaggatacttttcaacgcctaaaaaatttttattgggattatcaaaggcaagttgacttatcattttacccttacccattccaatctctattattcaagaatcatcaatatttcagggtgtttttacaagtaaattctgattttgaattctttcaagcgcatcaggaatatttcttagacgcatattaaaaaattttatattttaaactatgcatgacaacttaaatcgtgttgaccacgcaattcaaaatgttcatcaacaattccgctttcgatttcttcgattgtaaatgttgtatggtgaatatgttttaaagtgtattcaaccgggatttcaacctcggtgatcgcctctaactgactaatttgaacctcttcggtattaaccatatctatttgacgggcaatttcgtaattctgctcaatttcaacaagaggttccggttcaactactggttcaaaataaactggttcaattagtggctcaggttctaatggttcaggttcaacctctaattctaatggttcaggttcgtgaaaaactggttctggttcaattgctaaaactggagcaggttcttcaactggttcctcaagttcctcaacttcctccattgcaggattttcttcaatttcagttcctcaatgcataatttttacgcccttaccatcccgcaaatcgccggtataaatcataattaaagtgataatatttcaaagtaatgaaagtccaagaatcgctccaccagtaattgttagaatataaacatcgtttctaatctcatcttgtgcagacgatcctaaatacatcatctgggaaataaaaatcattaaaagaccaacaattgtaaaagtaaatctaattattgcaagactaaatctacctaaataccagaagccaaaaccaaacaaaccaagcaaaagttcgttatagaatgcatcactttgtaaaaggccatcttttctttttttgtctaaacgtggcattttttctccttttttttgcgaatacagataaaattatggtttttgaaagaatttaaaaatcaattttaacctatcgatttgaaattatacaataaaaacaaaaaaatgatataaaaaaaatattttttttatctttttttattttaccttttttattcttttttctggaaatcgactaacgtataataataaggacttcctccttgattttcctcaaaaattgatttttcaacaagtgaaatattaacccctgaaattccgcttcgatagtttgaaataatccgggcatattcatcaagcgggaatttttcgactgttttgtttaggaattttggatatattcgaattcaaggacttagatttactcttgtattaattagtttattatttttatattcttcttgcatattaaatgtgaaaatgtaattttcctcatttaataagaaaattttataattttcaatgccgtttccttcagtatttttggattcatttgctaattttacaattactatatcgttaaatttattggactttggcagataaaaactatttttgagtgcttgatttttcagatctatgttaagatcctcattttgttgttgaaattgatcaatttctgctagtccacgaacaaaaatcgctgattgaagattggctaataaccagagtcaattattttcgaataaatcattaaatgatctttttgctttttcatataaaagcggattttcctgtctattaccaaaagctgtaccacttgaatttccaggtcagggatttattggattataaaaatttaatttaaaagctaaatcaaggatatttttttcagtttcaattttttttattcgactaattagttgtttttttgaatcctgacttggataaatttttgttaacagttctaaaatgatactattttcaaagaaaggttgggcaatatttttttctgtagaactaattatagcaaatttttggtattttttttttaaaaaatccgaaaaatttacttggtttgcgcagcttagcaaaaatagactactaaaaaatggtataaaaccaaaaaacagtgatttttttaactttttcattttattaactaaatttctcacttataatcatttgtgctggtaaattatagcgaaatttttcaacaaaatctttttcaaaatcattatagctttcttgagattgatggtataaagcttggtggaaaatttcggtaagaatttttattgaaattttgttttttgttttgggaaaataaaaaacaaaaggatttaaagtaacttttggaattttgcttgatatatccacctttaaattaattaatgtattttgctttagaatataaagatctttaaaggtggtaagaattaaggatgtatcgccttcagcaattgattcaagaaatttatttgcataaaaaaaaggctcaaaaagtggttcctgatttctaacatattccttaaattccggactatgaccaacttttttaccagttacttcattaaattgatcaggaaaagtgtatcatttatggaatgtaagactaattttatcaagtctttcgagaataaaaagtcaattttggcttacaaaatttttatattcggcaataattaagtcaaaatctttttcatttctgtttatactagccattttttggttaattaatttccagtctttttctaatttttcaatattttgcttactatgataattatttaggaaagaaattctttctttatcgttattttttcagattgcattaaaaatatattcataaactcggcgcgtactaaattcctctattttttcattattttttttaatctctagttttttatcaacaaaagaattatatttatcgagataagttgattttggagttgtatttttattgagtttcttttcttcttctagacttttttcaagatcaattgagtataaactgtatttataaaatttaaaaggactgttaaaatcagaaatatcagaggtaatgttagtaaaaaagtttgatttttcaaggtcttttttctcgttaagaatttcttgttctacttttgtctcaagattttcaagctgattttggtattcgatctcaagttctttaagtttttctttggctttttcgttctcaagccgtgtctggtcagcgtctttttctaatttttcagaattttttactaaatttaagcttatattgctatttatttgaccaaccttatgaaaagttggttttttttgcagggattgcaaaaattcaagctgctctttactacatttttccggattttcaaggctacaataaccagcttcatcttcctcttcatcttctagattttcatcagtattttcgggtttaatttcttgttgaattagcgatttttgctcctggaattcatcttcaagattttcccttgctgtttttaatttattctggaagtattttttctctttttcgttaatccaattttcaagactatttataaacaaaaatttatcaggaatttcctcatcaagatagaacatattataatctaatttagttttaagttctgattttgagccaaaaacagtgaatctaataaatttatttttatcaaaaattaaataataaacattatttatctcaaattgattctggccagaattaattttgataaaatcaaaatttttattagaaatttttattgttttatctttgattttttctacctcaagctcctgcggattttttaaaaaacgcgtttgataagggttaaaaataaatgataatttttcaatattttctaataaaaacagtcaattttttgctagatatgaatgaattgtataatttgcattttcccttgttgttaaatattcatcatttatcgaacgaaaataaggttttgaaaaaataagtgaatattttaattcttgacttatttttaggccatttttgttgatctgatttatgatatagtcttgtttttgcccttcattttgagcaaaaattgaatcaacaaattcctgaattctttgattttttaataaggatttattctcatttttgggaataaattcataaaatttataaatactactacaagaaataagaccaaaaaaaggagttactgttaataaaaaaaatgaaattttttttagcattattcactttcacgactattttgagaatatttttgatacattttatataaactatcagttttttgaccactataataaatcttacctttgtcgattagagtcaaactatcaattaatgtatcaatttcatataaattatgacttgacaaaaatattgttttaccttgtttttgaagaatttttataattgcacggaattcatttcgcgctgaaggatcaagattagaaaatggctcatcaaaaataattaattctggatcatgaatcaaagattggactatcataattttgcgtttttgaccagatgaaaaattaaatggttttaattttgctaaattttcaatttttaaaaatttaaaataatagtcaatttttttctttaccagttctggttccatttttgataaaaggccaaattcatataaaaactcataagaatttaactcacggggaaaaaaagaattttccggaacataaccgatgaatttttttgcctcaggtaacttatttagaaaattgttaattaaaatttttccggaaaatttttgataagcatcaacaatgcacttaattactgttgttttccccgcgccatttttgccaataaatgcatgaatttggtttttttttaaccttaaaactaacatttttaacccctgcttctgattttgaataaatttttgttagattttctacttccaaaatccaatcagacattatttatagtcctttcttgaataaataataaagataaaaaataataaaattgcagaaattagggcccagattactggataaattttttttgagacgacctgatagtggcttttgatttccatcatctgtaaaactggctgaaataaaaaattattgctttttgacaagttaaaacgtttaattactttattctcaagcactcgttgttcagaactaaatgaggaaaagccgccgatttggtagttttctttatcaattttgataaaaattggacccggatcgtaattattttgctcattttttaaaaaattatcaagtatttccgtgttttgtctattaaaataaagtcaataaattagcgcagttgcaagatagatttttttttggacttgattttcaacttttttaatatcaagtttttttgctaaaaccgcagtattttcatcatttagttccaaaagctctttattagctgaaattgtatccgaaattttttcaagaatttctttctgacttactttattgctaaaatttgcaaaaaatttatttgcaaatttatcaaaaattggtgaagataaaagttcttttattaaatttcactttaatttcccaacaagatcagaagtaagaccaaaagtctgggagtcctgaggtaaaattttggcaaaattagcagcattttcacttgcataaataatttcgcggttttctagattttcaaaatgggaatcatttttaagcgatcccgggactaaaaaaacttcctgtgatgtcgataatttatatttttttaattctggacttgtagataaaaggtaattatttttttttgatgccaaattattggaataaatataattttttaggaaactttcggggattccgactgcattttcaattgcatcccgatcatttggctcaaaaacattaattaactgataaggaatcaataaataagaagccgcctgtcaagcttgagctgcagctgagctatcatttcaagcctgttggatatattctacttgcctttttgaaaaatttgggttatctacttgttttggtataaggaaaaattggtcttttttttgattaaggtagaatttttcaacatctacaattgtatttgaatcataattttgatgttctaaattaagaatttctgcaaaacggttaatagttgatgttgcactaaaagctgaactagatccaattagaataaaaggagaaaatgaaaaaactgcaattgaaagcgataattttgaactaaatttattgccaaataaagctgtcattgccccaaaaatcataaaagaaaaaaaagaagataaaaaacctcataataaaggcgaatttacctgacctaaatatttaaaatttatcatataaaaggaaacaagtaaaaagctgataaaaactgaccataaaatcccaaaaaaagttaaaaacaaaagttttgtaagaataaaatattgccgcgaataaggttttataaaagttattatatcaacacttgaagttgataaatccttaaaaattgataaaaacatataagaggcaataattattgtcaaagagagatttataaataaaataataaatgagaacaaactaaaacttttctcagttgcatagaattttgcaattaaagcaagcatcattgtcattaagaaggaaagagtaatgaaaacataaattactttttttttaaaacttaacttgaatagaaatctaaaatattgattagatctaaaaatatttgtcctgacttgtaacaaagtcaacctcttctacttatctaatattgttgtataatattagataataatttgtaaaattttaaaatttttactaaattaaaaagcggaaaaccacttttaaaaaaataaaattaatatctaaaagtgaaattataacataaattatcaaaaagttactgttttttatttttaaggaaaaaatttatgataattggctttatcgggataacaaatacgagtataaatttaatttctaacctaattttgacaagaaatgaggtggaattcttaataatagataataattttttacgtctaaatcaaataattgaagaatttaatagtattatcgactatggaagacataagaataaaattaatttcacaaattatcaaaatttggaaaaagctgatattttaattattgaaccaaagcaaaatcaagcgccaggaatgaatttaactgatcaggcaatcgaaaatgctgaatgaatttataaaactggatttttagtacggaattcaaattttaacggaattacttttattttaggttattataattcgattttgtgtaaaatttttagttccacatctggacttgtagggaaaaaagtctttggaattggcactattttagaaaatatttattttaatatgcttttaaaaaaaacaaattctgatctagcaaaaactgctaatcttcttatccttggagatcaaggaaatagttttttaatcaatcaagattttaaaaataatgaaataacagataaaaataatgaaatatttgataaacttattcagaaaataaatgaaaaaagtttagaaaaaattattagaaaaacggcagaaaattgactgttagcatcaattttactagatattttactagatatttttcagcaaaaacaaagttttttcctaataaattcttgagttgaatcattttataatataaaaaatgattttttcacaattcctgtcaaaatcgatctatcaggtcaaattgaaactaaaaatattaacctaaataagcaggatcagcaaaaattaattcaatttatgtgaaaaaaagatgaactaaacacgcttattgacaaatatttattaaaataagataaaaattttattattttttgatataattttttttagtaaatagtttttgtgtttaaaactggaaggaaaagatggcaaaacttaattcttataaatttaaaggaatcggggcctcaagcggaattgcaatcgcaaaagtttttaaattagttgaacaaaaaattgaaattagtgatcaaaaagttgaggatattagcactgaaattcaaatttttgaagagggggtaaaaaaatctgttagccaaattgaaaaaattaaaaaattagcaactaagttagcaaaagatgagctcgaaattcttgatgctcatattttgattgcaacagatcctgttcttaaagaagatacaatcaatttaatcaagcaaggatattcagctgcttattctttaaaagaaacggcaaaaaatcatactaattttttacttgaaaccggggatgaatatttaatggctcgagcaactgatatcaaagatgcctcacaaagaattattaaaaatattttaaatttgaatattttagatttaagtgcaatcgataaggatgtaataattgttgctgatgatctaaagccctcagataccgcccaactaaattcatatgttaaaggttttgcaactaatattggctcaaaaacttcgcattcagcaattatggcgcgaagtttagaaattccagcaattttaggtgttagtgatattcttgaaaaagttgaaaatgatgatattttagcaattaatggcgatcttggttatggagttattaacccaaatcaagaagaaattgaagaatttgagcgccaaaaagccaattttgaagcagaaaaagaaaaattacaagaatttttaaataaaaaagcaactagtgctgatggaaaaaaggttgtaattgctgctaatattggatcagttgaagattcatatgcagcaaaaaaagtaaatgctgatgaaattgggctttttcgctcagaatttttatatatggacaggtcaaattggccttctgaagaagagcaatttttaagttataaagccgtaatcgagagtcaaaatccgaaaaaagttgttgttagaacccttgatatcggcggcgataaaactttaaaatactttgattttgcaaaggaattaaacccttttttaggctatcgggcaattcgtctttgtcttgataaattagaaatttttaaaactcagcttcgggcactagtaagggcttctgaatttggaaatttagcaattatgtttcccatggttgcaagtcttgatgaattttttcaggcaagagcggtttttgatgaggtatataatcaaattaaggctaaatatccaaatgttgctccaaaaagcaacattaaaatcggaattatgattgaaattccgatttctgcaattcttgctgataagtttgccgaacatgttgattttttctctattggcacaaatgatttaattcaatactcctttgccgctgatcgaatgaatgaaaaagtcgcttatttatatcaaactttaaaccccggtctgttaaaacttattaaaatgacgattgatgctgcccatgcaaaaggaaaatgagtgggaatgtgtggcgaaatggcaggggatatcaatgctgtaccgcttttattaggtcttggacttgatgaattttcagtttctgcaagtagtgttttaaaagttaagaaactaatttccgaactaaattatcaaaaaatgcaggaaatagcaaaaaaaacgcttgaattttcaactgaagagcaagtaataaaatatcttgagtctttaaatttaattcgccataactaaaaaagcacttaaatttaaagactttttttatattaaatacaaaaaaatatcaaaaaccgaaaaatttaaaaaaaaataatataatttttcggtttagctctagaatataattttttttaattcgtatttttttctttggaaaaaaataagtttttgatatacttttaaaagtttatgataaataagcaagatgtaataaattattttaattatcttattgaatggattaggcaagaagttaaaaaagcccagaaaaaaggtgttatttttggactatcgggaggtgttgattcagctttagttgctgttttagcaaataaagcttttccagattcacacttaggcttgataatgccgattcgcgatatgataactgatatggttgatattgatcttttagttaaaaaatttggtattaaaaataaagaaattaatctaaaaccagcctttgaaaatttgaaaaaatgctttaatttaaaaaataaattagcaaattcaaatatccaaccacgccttagaatgactagtttgtatgcatttgcccaagaatttgattatttagtgcttgggacagataatttttcggaaatgtatctaggatattttacaaaatatggcgatggcggggtcgatttattaccaatcgttaatttaactaaagttcaagtttgaaaaatggcagctgaaattgggattccagaatcaataattaagaaaaaaccaagtgcaaatctttgagaaaatcaaactgatgaaaacgaaatgggattcagctatggtgatttagatctttttatggaaaacccaaatcttgtaagtaaggaaattgctgcaaaaattacaaaattacatgaaataagtagtcataaaagggatcaaattcctcgtcctttaaaaaaattaggagaaatttaatggctggacattcaaaatgagcaaacataaaacaccgaaaaggtgctcaagatgccctaaaagcaaaaatttttaacaaattttccaaagaaattatggttgcagttgcaaaaggcggctcagatccaaattcaaatcctgcccttagactaattatttcaaaagcaagagcaaaatcaatgccaaaatcaaacattgaaaaggctatcgcaaaaggcgaaggatcaacaagtaatggtgaaaattttaaagaaataatttattctggaacgttatctcatggaatttcggtaattgttgtaattcttacagataatataaatcgggcaattgcatctttacaagcgctttttcggcgggcaaatggtcaaattggcaaacaaaactcaattccttatctatttgaacaaaaaggttatctcgaaattgaaaaaaataatctagacgaagacgatttaatgcttttttcccttgataatggtgctgaggatttccaaagtgatgagacaaattatatgatttattgtcagcctcgaaaaataagtgaactaaaaaatgaaatagaaaaaaaatttagccctaatttccgcgctgttgaaattagttatttcccgaatgaatgagttgaacttgatcaagaaaatactgaaaaaatattaaaccaaattgataattttcttgatgatgaggatatccaaaatgtttatcataatttaaaatttgcataatttaataattacgcaaatttttttaatatttatatattttctagtaaaacaagactgaactcaacagccttttttagtccttttttaattgaattatttaccatttctttatcagtgttgctctcaatctggtcagttaaatatttaacacagtaaaaatttagcttatttttacttgctgtttgggcaaaagcaaaagcttccatatcaaaaaaatgaacaaatttaaaatccttaacttgctttttcttaaagataaaactatttgatgaacctagattaaacttcttaccaattttattattttcataaaattctggttcactaggaagtttacccggcggatatcaaggtgttttggcatctaaaaggtagaatctttccggaaaaactaattgtttttccatttctggaaaattaattgataaatttgcgccacaagctccataattaataagattttcaattggaaattcttcaataattttttgggcaaaaattgctgcattaatcaggccaatacctgtattaatataaagaaaattgtattttttataccgatagacagcaatttttttttgaaaaatttcaatatttcttaacaaaattgcgccgaattcttctaagtttgctgcttcattagtatcggcataaaaaattgctgatttaattttggtgtctagcataaattttgttttgctctcgtgaatttggtaaatctttatggttgttataggcgatttcaactaatttttgaaatgctttttctagatcctgtcttgctaattttcgtaatttttgcactcctagaaaccgccgaccgcgggctaatttatcggcgacataaacaatcttatcaaataaggacatctcaaaacagaggctcgtatgacatgaaattgcataaataatttgctcaaaaggtaaacaataaacatttttaagtcaaattgaagccgaaagttgatgaagttgatattcttgtaaattcttaactgaaattttttgacttcttagaaattcgagatgttgatcttttgttcatttctttgtaagatcgtgaaataatccagcataataagctaatttagagtccaaattgttaatttttgcatactcatttgctagtttggccgtatttttggaatgaattaagcgcttggaataacctaaaaaacttgttaaaatttcttcggcataaagaaagtttttacctatataagctctaacttttgaatcaagaccggaaaattcaccttttctaatttgtgatgagctgaaatttggcaatttcgttggtaaaattaaaccgttataacgtttgagttggcgtaaatctggataatttttacgggtaaaaacaacaagttgaactttttcaagaatttctttataatttttccataatttaaaattacgaagattatcggaaccaataattaaaaagatctttgtattagggtattttttttcaaaaaaattaatggtatcgattgtataactaacttttttcgctttaatttcaaaatcacaaacatctgttttttcaatttgaaccaatttgagcatctcatagcggaattttggatcaataatattttttttttgcttcttaagcggatttatgtaattggggacaaaaaagagtttatcaagatttaaaaattctattgctttttgagcaatttctaaatgcgctttgtgaacagggttaaaagtccctccataaatagcaatctttttcaaagtcatcttttaataatcaattgctccgactgtgacagtggaacgtatttccttaattttttttgatttggcaatttctttttctggattttttaaaaatcggcggatgtaatcgcctacgccaccttctttattagttttgtttaataccacggttgcttgtttttttacctggggcggtgaatttttcatagctaccgaaatagttgaaaccgtaaacattccgatatcattgtaactatctcctattgaaataatgttattaagatcaattttataataacgagatagcattgaaactgcctttgatttattgaccccaattgctgtcatatcaaatacaaaagtatgattttcaccttttgatcaagcagaaaattcacctaaatcaccataacgtcgttctaaataaaatttaaagtcagcaacatttgttgttggttttgtatctagaattaaacacgtcggttttaaagggattttatgaaaattaagacctggttttaagttactaagatggttaaatccaaaaacttgctcaagttgtttatcgcgttttttaattttagcccatcctggaccttcgattgccacgttagaaatttcagctttaacccgtttatcgcccattatatacaaaatatcgtttaaatttatgtaatttatgattggaacaaagtcactatcagtcgggttgtgaacaaaagcgccgttaaaattagcgacaattgtgtttaacccgagcttttcataaacgggttttgttgatcttcaaggtcggcctgttaaaatacaaactatatgacctaattcaattgcacgcttaatttctgtttcagtatcaggatgaatttctgaatttgcactatctgataaaacggttccatcaagatccaaaacaaataaaaaacgggcttttaaggttttcattttcgaaaattatactataaatctgttaaaatataacaaaaaaatctaaaaataaagttatataattattattaacattatatagtaaaacttgataatttaaaagttttttttttttttttttttttttgcatctaagcggctacattttataataaattaataattttgtagtttttaattataaaaaagctgaaaatgttaattattaaacggttatttttaataaatttaatgaaaattaaaaattttcgatgagagaataacaagattttagcttcttttaaacaaaaattttcattctttttattattataacgctattataacaaaaattaaaaaatttccaaataaatttgaaaattttttaattaacattttcaagctagtttttaaagaattaaaagcaaaattatcaaaaaataaactaatagtcggaacaatttaatctatttttggtataatacaaaaattttaaaaaaggagaaaaataggaatttctggccttttttattattttttgaaatttattagcttttttattaatattaggtaagattgattagctttcttttttgaaaaggtcgtcaactgaacctataaaagcaaactcacttggggagacatctaaaaattcaccgttaatgatacggattactgaatcaattgtcttttcaagtgggacatatactccgggttccttggtaaacgcggctgccataaagaaattctgggtgaaaaagttttcgagctggagcgcttttcttacgataattttgctctcggcatcaagctcgtcaaaacctaaaattaagataacatcctctaaatccttatattttttcataattgatttagccgcaataattgcattaaaatgtctttcaccaattatattaacagagactgaatttgaagttgaaacaagtgggtcaaaagccgggaaaatattacgagacattttatcacgggagagcacaaatgatgaatcaaggtgagtaaaaagtgaaattgcagctggatcagagaggtcatccatcgggagaaaaacagtttgaaatgaagtaattgatccgttttcatttttaaaaagtctgtcctgaataaaagcaacatcggaagccattgttgcatggtaacctccgattgaaacatttttttcaagggcagaagaaacctcatttgttgcctgaataaaccgataaatattatcgataaataaaagcacatcttctttttcataatcacgggcatattcagccgctgttacccccattggcactatcatcgaacgagcgccaggagtttcgttcatctgggccacaaacattgttgattttgccattaaatttgactcttttagttctaaaaataactctagaccttcacgggaacgttctcctgaaccaacaaaaattgaagaaactttctgtctttgtttagaaacattaaaaataatttccttcattaaaacggttttaccaaccccggctccaccaaaaatcccgattttatacccttcaaaaatcggcacaaaaaaatcaagcgccttaattccggtctctaataatttatgtctaatgctaaaattttcttttccaacattaattatcgagttaatcggaattgttcttggtcgatattgtggtgtattttgggattgccctaaaatgttaaaaacttgattttttgctgaaggaccaaccggtacttgtaaaaaattaagagtatttattacttgtgagccaactgcaattggagccgctttggcaattacaaccgccctgacagtattatgattaagaatttttttaataattaaaaccgtgcggttttcatgcataactaatgcttgttcgagctgaattttttccaattcacttgtgaatttgatctcagcaacgtttgtccagatctgtgatatatagccaaccatttttatctacctccaattgtctgcgattttttaatgatattatcaagtaagctctcttccattttcggaaaactaaggggaatttccaactgagttagtgatccggtttttgctagaaactgatttgttagagttgcaaaatatgaaccagcaagttcattatcaacaaattcattatttgtatatttattaaaaacttgtttcgcaaatggatctgtttccacaagcacccttataaaatcaacaacttttgtaggatcttgaacatcttttaaaagtcctcaagaaattattttaatccccattaaaacacttgttaaagaataatgagaataccctttttgaatcaagaactgttcaacttgtgatcctttaaataaaagatcggaagtttccttgttaagatcatagtctaatttttctagttttgctagctttatttgtttttggtagttataataaagtgaggaaatttcttttgaaattagacgaatattttgagcttgaaccgatgatccagtccgagataccgaaagtccgatattaatagccgggatttttccctgagcaaaaagggcagaagaagtaataatttgcccatcggtaatcgaaattacatttgaagagacaagggcggtgatatcattatcaacggtctggagaattggcagggccgtaattgatttgcggccaataaattttcctgatcgttctaaaagtttagaatgagcaaagaaaatatcagctgggaaggcttctttcccaattggctgatttgttaaaagggcgacttcacgccagacactagcatgttttgttagatcatcaaaaacaattaaaacatcataattataactaagattttcagcatgagccattgcaaaataaggagctaaatactgatcaaaagggctagttgaaggggcatggagcacaattgtattcgccattgcttcattttggaccaaatcgtgatataaagaaactaagttttgccgtttttgaccgattgagacataaatacattttgtagttcgtgagtctttttggttaattattgtattaattccgatatgcgtttttccagtttgacgatcgccgacaattaattcacgttgtccaaaacctatcgggttaaaaagatcgattgcataaattccggtataaatttgccgatcaagtaattcacggcgtaaaacgccggcggcagtctcgaatgccgagtgccgatattgtaaaaaagttgttggtctagccgcgcgcggctcgattatatttcctgataaatcaatgattttgccaaaatattccattgaagtaaggactttatcaaaatttggaagttcgattagttcatcattgatctgaattttccctttttggttattaaaaagtaaataagcttgatcctgagaggcctgaattacgacagctttaatctctggtttatcttttacttgaaaaaattgttgttcctgccagttatactcacctttaacaagaactacataatctagaacggatgcaacttttaatgccattattgatctcctttatttttttgacttactaaattttgttttcttttataaataattcggcgtaaaaagacggttaaggtaattaaaattccggaaattgtcccaattattaagtataaaagattatcctcaagtcattttgaggtatttgctaacttatattcttgaattaaatctgcaaaattttgaactgcatttccgctgtcttgactttggcctgctgagttttggtctttattttcatctttttgagcaaaataggcgatctggcccaaaatttgacttaactgattgatttcccgacctaattttgtcattttcaaaaatgaattaaccaaatttgaggttaatttataagattcattatgaaaaagggcaattttttcgtgggcctgtgcaaaaaaacggttaatatcttcacgagttagattgagtttttccaaagtcgcatcaagttgtttggcggcttcagaacttgactcagctttaccatctaattccgaaattgtttgttttgccctattaaatttttcctgaagaacatataaattaataaaataaattaaataataatgaagtcaagctttattattatcgatctcggattttttaagataagataaaaactgaaactgggaagctgaaaaaacacttgatagcgaagaatttatatattctcgggccatttttttctgggcttctaaaaaatcttgattataaaacacttttgtaagtagatagaaaaaattataaattgttgtttgtgaaccaggggaataatagcgaatttggtcaaaactaaattgatcattgacattaacagtttcaaaaaaattatcaattacggctgtaacccctaaatttgaatggtataagtttgttgtaattgcctgtctttgccagggacttgcgccttcaaagtcatcatattggagactttcataaactttttcatattttttcttatccgatgattcgcggactttattaacaaagtcagtaattttaatccgcgctttaatcttcccgtctgtttcactaatagattcaatattatatttaaaacgggaatttaaagggtttaaaaagaaaaaaatctcggattttttttcttgggatgctgaattataaagatttataatctcgcttacggacaaatttgtatattcaggagcaacaattgggggtagatcaggagcaattcggacttcaaattccggtttttcggagatttgaggggggttttgtttggtaatttttttaattgctaaattaatttgttctatttctgattttgaagaagacggatttggcagttgatttaaagaaaaatccagtaaaagcgactgtttttcaaagtagtttttgatccagtcatttcaggtggataccccttctttgcccattggttttgaagctaataaaatattttctttatcatcaatactttcacggtcaagatttagattaaaattctttttatagaccggaaattcttcctctttgaataaatattgtttataacctgattctagtcctttaaaataagttttgatcctttcctcaaattcttgaccttttaaagtattaggaacatccaaaactttatcagtttttactccttgaatttttgcatagtcatcgttttggttatttccccattcaagcccttgataattttccttatcaaaagtgacatctccacgttttagttttaaattatttgcaaaagcaaaggggctaatgatattcaaaccatatttgcggggatcttttttgatcccctcacgatttttctggaaataataacgtagttgaatccaaaaaaaactttgttgtagtctttcttcgacattatccttatttttggcattaatatcggctagttttgctttaatatcattatcaacctgcccaataaaacggtcaataaattcctcttttttgctttcccatcaagcctgattttttttaagatcttcattagtgatcggtgttggatctttttttggatcagcatcagcttttttttgatctttttccccatttttttcttgatttgactggcctgcctggcctttatcattatcagtttgtggtttttcttgactaataatttccttttgggaataattaatcgctgaggttaagaaaaaaagcggggaaaaagttaaaaatggaaaaaatcgggaaaaaatcaacttattttttctatttttttgttttttatacataatttacctcagttctgaccagaaaaaataattctttaagtcgattttcttcattgacttgttttgttagttgataatttttgtataattccaaattttcaccaatttctaaatttgcttttagttgtaatttatgcaaaagtgtgtttttgtttttttgttgagcttttttttgaaagaaaaattcttttttatcaaccttataaaaaattagatcttcaaaaagatgaatcgaaactgtatcttcaagggaaaataaaagcgagtgatgagcaaaaaagtagtaaattccacttgaaatttccacttttatcaacgaaaattctaaatttgagacaataaaaggttgaattggggcaaaatatttttcttgttcaatattaagggaaattttgcaattttttaaagtaataattttattttcgggggttagaatccgaaaatttcaaagttttgcctccatttagaaaactcctttcggctttcttttaatgacattgagctcttcaatttctagttcccgctcgattttgagaattgatgttcgcagatgacgcattttctcttcaatctcttttaaaagcgtattttcatggattagcttatttttatagacaataaattgggactctaataataaaatttggactgaagttacaaaataactaagaatttgactttgataaaattcttcaaaatttggaaaaaatcttactctttctagatttttttcaattttttcaagtacttcctgatttgtttccattttgaattcaaaatggtttaaagggaaaattgttgcgataaaatcggtgattttatttgaataaactgccatttttacagttgaaaattgtcgatttttgattccataattgataatttcaccaattttcgttgaatttttaaaagtattatccaaattttgaaaactttcaagaatttgcatcttatttttgttagcaaaattaagtgcccgatcgcctaaagtaataataaaatctttttctttatagttttcaagaatttttgcctcaatttggtcaaaaaagttctgggtatatttctcatcagaagaaggataaattcagagactaacattttggcgaatcaatgcttttctagtaactaacgataatttagtgctaagcgatctttgataactaaaatttaccaaaaagtactgaccaattagaaaaaattcataaacattgcgaattgtgcgtaaaagaaggttaatttttatcaaagaaatattccgatttagtgaaactaaatcgtaaatttttgcaaagttagcccgtttttcctttatttcattaatattcataatttaaaactttcaaaattaggctttttttggcttattttgctgattttggatattttcaagacttgagactaaagaaacttcactaaaaatcacttttaatgttcgcgtctgtggatcaaagaaaataatacaaccctcgacaacctcgacaaaacggtttttattggcaataaaatcccaagctagaatgtttaaatttgcaagaactgaagaaaaacgttgatcgttactatcgctaaaaaaattacttgccatcacatttgaggattcttttagagttacaattggtacaagaccttttgagccaaaccgggatgaacgctgccaggaaatgacaaaatttttaaaaactaattcagttgtagccttataagctgctaaaactttttggtggtatttttcacggattactgaatttgctttctgagaagaaacaagtaaagttagattaaatagcgcatcaaaactaacaaaatttggatgattaattaaatcataataatcacggaactcggtttttgtatcaatagtatttgaatttgcttctttttttgcagaagatccaaaaaatttcataattaactcctattttttttaactttttgacttaagtgtttttaaattttccgactgggaatttttagtatttacttgtttttcaagcactttgtaatctaattgcgatttttttgtttttaaaattaaagtattttttccaattgatactaataaattaacaaaaacgaaaattccaactaaaacactaagaattccataaaaatagaaactatagtcaatataaaatgtcgatactaaaggacttttttcggcctcaagtgcaacaacggcatttgtataaatatgaatatttaataaataaatgaaagtaaaaagaatatataaactagtaaaaaagctaaaaatgagctttaatcataacggaaaatctttctttgttctaatcaataatgaataagtaataataaaaaacactatttgacttaaattgattcaaatagtggcaaaaactacataagataaataggaactaacaaaactggaaataaaagatatcaataggacaaaagcaaaaaaacttaacttgtaatccttaattttcttttctaattttgtaaaatttaaaaggaaataagtagctaataaaactagatgaatcgaaattccgataatcattggcaaataatttgttgttaaattctttccaaaaggtaagaattgaacaaaatttgtgcttgcaaaaatatttatataaatactataaaataaaagtgcaaaactagcaaaaattaacagtgaaaaacttggcactattttttttagtcggaaaaaactttgacggtaaaagtaaatttgcggactaaaataaagtaaggaaagcactagtaaaaataccaaaattgcaattaaaatgaaagaattactaatttttccaacttcggcaataaaagtatatagccaatctgcaaccgggttaccataacttacagtcgcgataatatcagcttcctcatttgagaaaaccattgatgcaaaaagtccaaataaaatcccaaaaataattaatgaggctgccaaactgacgtgacgaaaaataaaaaactttttataatcataatttattttatcatttttccgaccaattcagagccagagactataatcaaggaaaattaggacaaaaatttgtgttgaaaatacaagaatataagttcattctgttgtaagtcaagcaaaataaataacaatattaactaaaaaaagaccaaaaaatgccgataaaataagatatttttgcaatttttccttaaggcttaaaaatttaagtcctttaaagaaaaaggcaaaactaaaaaataagagcaaaactgatcttgtcattcgaacagcaagaaactcacgcatttcatcttcaattggattgaaaaatgttgaaatacttgagactggctgatcagtatttgaaatatttagaaatgatcgtggtccatcaaaaaaaatggctaaagccaaactagttaagaataaaacagtaagcaaaaaatacaaccactgcttttggccattttttgatgggtttatttctaacttgaagacttttttagatctaaccttcattatttctcctttcctagttttttcaaagatgaaatatattataactttttttttttttttttttttgccaaaaaaatgaaaattaaataaaggtaccttaaaaaaatcaaggagaatcactattttttttctaatttttttaaggtataataataataataataataataataataatactgattaaattaggcaaaaagttagttatataataaaaaaaagaaaaaaacgagaaattttaagtaaaaattcattttaaaactattaaaaaacagttttaagccagttttttataaatttttgctcatatttctttataattttttaaactatgcaaaaaaaaataatttttagcgacatcgatggcacactttattgtcatgattttaaaattagtcttgaaactattgattacataaaaaaaaacaaggataattttatccttgttcttaataccggaaatccactggcttcccgaatttttcaggttgcaaaaaatcttgaaattcgttatataatcagctcaaatggcgctttattcagcgaccttgaaagtggaaatcatactttaattaacggttcaatttcccttaaggagcaaaaatttctctttgaaattgccaaaaatttagatttacaactaaatttttgaaatactgaaaaatattttagttttaatgcaaaaacaaaatatttttcattttttatctacccacatcttcaaggggaaaaagaggtaatctttactgattcatatcaggaaaatgttgttaaattagagttaattggacctaaggcccaacttgatcaggcctatgacttacttgaaaaaaatcaggaattagaggctgttttcattaaaaatttaagtattgaaattactaaaaaaaatacaaacaagggaaaagctgttgaatttgtcagcaaaattttccaaagcgatcttgataatgtaatgacaatcggtgatagcggaaatgatctttcaatgcttaaaatcaccaaattttcctatgcaatggcaaatgcatcaaaaaaagtcaaagaaacagctcgatttcatacaagcgcatgtaatcaagacgggctaatttatgcgattaaagattttttataccggaaaaaatttgactaaaattatatttttcgaaaaaaatataaaaaaatttcaaaattaaactaaattcagttaattttgaaatttgtttcagttttacgctgttgaatcagttggaaaaagaaaactaaaatctgaattgttgcaatcgttaatccaataatttggaaaattagcgcagtcagtcagttattatcattatttaccaaaatttgtaagaattcataaattattcagaaaatattaagagttgctagattaactaagaaagttaggggaataaattttattgttttttgttttattcctaatatagtttgtggtaaaaaagcaaaatttacacaaaaaccggcaattatgccaagatatgaagccgcgctaataatctgacgttcaggaacaattttagctaaataaaaaataaaaagtaataaaattactagatagacaagaattcctgcgccaataaaagcaagattttctccttttttcttctccgttttaagcttatatgtatatacttggatcaagaaaactaaagttattagcccacaaaaaacttgggtaataaaaagtgggagatcatataaagctagtcctaacaaggtaaaaaagaaaattccaatataataaattcatcaactaagtaaggaagtttttggtggttgtttggcaatgaaagtattaattacaagtggaaggccaacaatggcggtgaaaaatgaggcaatatagccaattatatcaatatagtgcactttttttatcctatcaaatttataatttacaatttctgaaattaatttcagaaattgccttaattaataaaatttttgaaatttattaattaaattaatagaaccataactaaattagaagaaagacaacaattgtaataccaaaaaagattaaagttgagattgaatcagtaacagttgccaaaattggtgctgacatcacagccggatcacgtctaatcgattttgcaatcatcgggatgattgctccaagaatttttgaaaaaataattactactaataatgaaatcgaggaagctgccgaaattattagaatgtagtctctgattgttaaattcgaaattgaattatcagggatattaacatttttaatatcaccggttagggcaaaataaatcacaagtcttaaaaagtttagaatcattaaaattgtgccaataattaggccaacgctaatctctttaaagaaaacttttttaaaaaagttagtcttatcaacttcttttagcgaaattgccctgacaattgttgttgctgactgcgagccggcattacctgctgaaccagaaattaccggaatcattgaaacaattgtggtaataaatgaggcaagaccgattgatttaattgcattattttgacttattgcattagtaaattcttgaatgataaactgggacaaagttgatccaaacattaggatgattagtcaaaaaactcttgattttacgatctgtttaagtgtggaacgaatataggattcttcaacttcctgaggtgaaattcctgctagtttataaatatcacttgttgctttttccttgacaatatcgataatatcatcacttgtaaccattccgattagtctctggcttgtatttacaaccgggagtactgaaaaatcatttttggcaaaaacttcggctgcataatcttttttatcagttgtaacaagaaaagggacttgaaaaacaatttctttgatctgagtattaggatcagaaaagacaatatcttctaaagtagttgccccgattattttcttgttttgatcaacgacataataataatgcactaattcggagatatctttatagtttctaattttttcaagtgcttgatgacaagtcgaatctttaaaaagatagacgatatcaactgacataaaagcgccaatttgatcgtcggtatactgcaaaagttgatttatttgtttacgagtatcaatgtcaatgttgcgcaaaattcttttggcaacattatcagggacttcatcaagaagttcgacaatttcatcaacataaagttcatcaagtaatttattgattagctcatttggtaaacttagtactaatttggtctgaatttctggtgaaaagtaggtgaaaatatcacctgcagttgcagtatctaacatcctaaaaaataaaagtcggtcaaacggagaaaaacttgaaacttcttcggcgatctctgatagtggtttttgttttgtataattgcggacttcagtaatttttttggtagtaacaagctcaaaaagaaaagaactttttttatctaagctcattatttttaactattttttgtcttcaggtttgaccgcatttaactcttttgttaaaatttcaacaaatgaatcaagacttgtaaccttaaaaaaattagcatccctaacaattacaacttcaccactttgttctgagactacaatagtaatcgaatctgagacctctgaaattcccaatgcagcccgatgacgggcgccataacgatcctccagagttgattcagaaactgaaaaatacgttgatgcatacgaaattcgatcatcaacgataatcacagcaccatcatgaaggggagaatttttctgaaaaattgcaatcaaaagtgatgaattaatcattgaatcaattttgaccccatcagtggaaagattatccaaaagtgtgtttctctgaattgtgataatcgcgccgattttgttttttgaaagatgtttaactgcaaaaaaaagctcgtaaactatttttctttgtgttgaaattccaaggtcaagaaaactacgactgactttgtttttatgcaaagttttaatatgattaaagataaagaaaacaacaaaaacaagccctaatactaaaattagtgccactagtattaaaattggaacatctaaattcatcaggctcccttcctccccttatttacaatcacaggctaaaataatttacatttaaaattatatcttaatttaattatattagaaatatttcaatatttttccttaaattttcctttttttggagtcttaaataataaaaattctactaatctttgcaaaaaataaaattttttataaaaaacaaagattagtagaaaaaattttgtttttttttacaaaatttttaaaattggtactaaattatacctgccccatataaaacaaacataatcacaaccacaagaagcacagcaatcacagcaaataggacgaaccataaaacataggaaggcaagcctcaaattgttgatttttcggtagcaacaataataatttcttcatcttcatcaacacttgatgttgaagctgctattaccctagttgcctcatcgacactgagatcgccaagcccaacgcttagaccaccttgaagattatatccgccaaaaccacgtttggtattgaataattcctcatcgaccatcgcattatgttcatctcagttctgatcaagtaatgcttgataaacgatcccttgaaataatgggataattgctgggaatttattaagtgggtaatttcctagcgctaaaaactgcggataaattttaattcaggaataatcaagaacgatttcgacaatctgaggaatttcttcatggacaatttttttgccatgagctagaactaaaaggggacttatatggtgaaaattatcatcatggacttcataattaataatttttagaaggtagtcaattgaaagatttctcttggcaaaaaggtaacgacaagctggacaattttttgcttctagtaaaaaagctcggtatttaaggcagaatttacagaaataaacatgaacacaggagggacaattttcattataaggtagtttgtggccctgaccaaactgatatctaacaagcgcgcgggagtcaaaatatggataataagaaagttggtaaattttctcttcaatattaatatttctttgttttaatagttcctggcaagcaaggcattttctagcttctttataaaaagcgcgcaatttgctgcattttggacagaaaaaattatgattgcatgtcggacaaggagaattataagtttgctttcaaattaaagaatataaattctgataatcatttacacgtaattcacttaattttttctcaatatcaaaattttggagcctaaatctttcaagacaagttggacaatttttagcttctaataaataagttgcatatcgctgacatcataaacaatttgcattgtgattgcatgcctgacaagaaatttttgaacctaaattttcaaggtgttttgtatatgaaccataacggagctctaataatttggcatcaacattgaaatttttggctttaaatttctcaagacaagctggacaatttctggcttccaataaataagtgcggtatttctgacatcaagggcaagttgcattgtgattgcatgcataacaattgcttaaataagggttttttaataaaatataaggataagaaggatgggaaagctcaaaaattttcctgtttatatcaatatttttaaacttgaatatttctaaacatttaggacaatttctggcttctaataaataggtgcggtagcgctgacatcaagaacataaagcattatgactgcaagccttgcagatctgcgattctttttttactaaattttctttttttgatactaaattactagaacgaagctctaataatttagtatcaagatcaaagttttgctctttaaattttaaaatacaagctggacaattttttgcttctaataaataagtgcggtatttctgacatcaagggcaagttgtattatgagaacaagctgaacatgaagttttgaaagagctaaacgaagagactgagtcgcaaaattcagaatgctgataagcgatatcggcttctttttctccagcgacctcgagatccggactattaattataccatattccttatggtctaaaacttttttttcaacttttttttcaataccgacttcaaattctttttcttggccttttaaaatcaaaacttcggacgtagaactcacattttcaagtattttttcgtcaaattgatcggaaatttgttggttaaagattaaattatcatcttgattttcaagtttttcttctaattgaaaatcttgatcctgtttgattaaatttgggttttcagggttaaaactttcaaaaaaatcataagcatctgagggattttctagattttctaattctaaattttcatcagcttttttgccttgttggggaaaactagccgaatctaaaaggattttttcattttcactgactaattcaggtattttattttctagactatcttctaaaatttcgagctcaacaagatgacaaggacattgatgacttagggcttcagtttcattatctttttgacagatagcacattcaattttttgatcggcaccgttttgtttgatcgcataaagaatttcatcgatggttttctcatcctcggtaatgattaattcagttgcctgtttttgattctcgctattttttaaaggattttttaaatttttatcggatttttttgttttttcacttgtttgggaagctgaattatcaaaatcggaaaatgttttagctaaaaattcttcacgctgagcctgattaagcgatctaaagttaatcgctaaaggaaaagagattaccgatccaaatttattcccacgtaaaactcaaagtcgcactggagttttcaggctttcaatcttaagaaaaacatcagtaagtgagttaaaaataccaacggtttcttttgcaaatttaagacggtaatagcaatctttttccttgtgaaattcatcacaaatttccgttaaataaaatcttaaagttttcgttttgttcattttgtttagcgacttcttttaattataaacttaaaataatttaaattatagaataaaattgaaattatatgactaaaaaataaaattttacgttttgcttttcaaaaatctatttaaattgtaccataaaacagaaataaaaataaccttatttattcaaaaaattttataattttacatcttactaatttttttaacactttttttgttaatttcaagattttacttaaattttaaaggatttttttaattttgcgttaaaattgttaataatttttttcttgttttttcttagtttttcaacttaatagtttataatataaaaaaaataaaattttcaaaggataaaaaatgcagccaacctacaaaaataaaaagtttattgatgatattgattttttaaataaaactgtaattctccgtgttgattttaatgtgccgatcaaaaatggagaaattagttctataaaaagaatcattgcaagtcttaaaactattaaaaaaattgtaaataatggcggtaaattagtgattttatcccatcttggccggataaaatccaaagaagatctcccaaaaaaatcccttagaatagtagctgaaaaattagctgaaattttaggtcaggaaattaaatttatccctgaaaaccgcggtcctaaagtcgaaaatgcaattaaccaacttgaaaaaggtgagattttagtacttgaaaatacaagatttcaggacctaaataataaagctgagtccaaaaacgatgctgaattaggcagatattgagcctcccttggtgatgtttttatcaatgatgccttcggaactcttcatcgggctcatggatcaaatgtcggaattgcaacttatattaaagaatcagcaattggttatttagtaaaagaagaattagatgccctttcaaaactaattttttccccgcaaagaccattttatgcaattatcggcggggcaaaaatatccgataaaatcgggataatttcaactttattagaaaaagctgataaagttttaatcggtggcggaatggcttatactttcaaaaaagcacttggttataaaattggtctttcgatttatgaagatgacaaacttgaacttgctgctagtctagtcaaaaaatatccagataaattaattttagcccttgatgcggctctagccccagaatttgccgatcttgaacctttatataatcaggaaaatccccttgaaatccctgatcatttagaaggaatggatattggccctttaacaattgagttattcaaagatcatctaaaagatggaaaaactatcctttgaaatggaactttaggcgtagccgaatttaaaaattttgcccgtggaaccaaggaagttgccaaaattattgccaatctaaaagattgttatagtatcattggcgggggagattcaatcgctgcaattgaagccgaaggtcttagtaattcattttcccatatttctacaggcggaggtgcttcaattagttttattgaaaacggtgatttaattggtcttggcccaatccaggaaaaagactaaaagagctttaaatttaaaggtttttttaaatcacgcagatttaataactaatatttttcctaatttttctaaaaaatattagttaatgaaatttttttcattttatatcatttataatataaaaaatgaaaaaaattatgaattagtttaagattttgaaactaacttaattttatgaaaaccgttttttttgatgtaaagattgttaagttattaacaaagacagtgaaaataattctaaaattagcacaggaaaatccacagtttttctaccaggctttcttaaaatcacttgcatatcaaaccaagggctgaatttctttaaaaattaatcaacaattcatctttgatgttgtttttttcattatttgaaatttaatttctgatatatatcagaaaaattatcaaggattaaaactcataaattaaaaaaatttagaaatttttatatttttttaaaattttttttaatttccttactttttttaaaaaaataggcgattatttatttatatcgataaataatctagagaaaggaaaatcttatggaaatttttaaaagaaattttgttttcctaaaacaaaatttaaattcaaaatccgaagtttttgaatttattgccagcaaggcttacaaactgaaaatcgctgaaaacaaagaagaaattatcaaagatctggaattccgcgaatcacagatctcaaccggtcttgaagcaggatttgcaatcccgcatgctcaaagtcaggcagttttgaccccgagtttattttttatctcccttgaaaatggaattgaatgggaaaattttgataaaactaaggcaaaatatcttttctgcattttgttaccaaaaaaaggttttgcaactagacaagttgaactgcttgcaaaaattgctagcataattcttgatcctgaaattagtaaagttctaacatcggatgatccagattttgtctttaaaaatctggaaaaacattttcttgaaaaattagtagataaaaatagagaaaatcaagaaaatgttaaaaatctaaaaaaagttatcggaattacttcttgcacagttgggattgctcatacttatcttgcagccgaaaaattggaaaatgccttgaaaaatagtggctattttcccaaaattgaaacgcgcggctcggctggtccaaaaaatattttaactaaaaatgatataaaaacagcagaatttgttataatttcttccgatctcgagattgatacaactgcttttattggcaaaaaagtttatttttgcacaacaaaagatgcaatccataaatcagaaaaaattattgaactagctcaaaaagccccaattttaaaggaaaattttcaaaaaacagtcaatgaagaagccaaaacaagtcaaggtaatttcctaagacatataatggctggaatctcttatatgattccttatatcatttttggtggaattatgattgctttatcccttggaattggtaagtcaatttatgggaataactctatagctcccaaaggtgattttctctggtgaatgttccaaattggtctgatctcctttcgattaatgatcggcgctttaggtgcttatattgcctattcaatttgtggacgggccgggcttgcccctggatttattgtctcaactgtggctaattcaaatgatcttttctatggaattggtggaatcgaggtcaaaacgccaatgggatttattggtgcagttttatttggttttttagtcggttatagtgtaaaatatcttaatagtctaaaaatacaaaaatcacttgcgggtattatgccgatttttgtaattccgatcggcgtaagtcttttttggtcactaatggcaatctttataattggggcgccgatcggctgaattttagacaaatttattgaagcactcaagtcgatttttcttaaaaaagatagtcttggcctcggaatcgcctttctcttagggcttttacttgggtcaatgattggttttgatatgggaggtcctattaacaaagttgcttatttaagcgctaccgcgcttgttgctagtcaaatttatgagcctatgggaatggtggcagccgctattcccgttgccccttttggaatgggtcttgcaactcttatctgaaagaaaaagttttcccaaaaggaaaaatccctgggaatttcagcatttgtaatggggtttatcggggtttccgaaggagccattccctttgcgattgtcgatccaaaacgggtaattagtgctaatgtaatcggatcagcaattgctggcggtcttagtggtattcttgcagtaactaattccgccggacacggcgggccaattgttgctattttaggggcaattggatcagacaagcacggacttggtctgggaatcgcctttttcttgattgcaataattattggttcgctaaccacggcactaatttatggttttagtaaaaatcgtagtataaaaattttcactttttgaaaaaaattatgaaaccgaaacaaataattatgaaaattaataataataataataataaaacagtttttttagtagtacttgtagttgcacttgttttgattattgccggaattataatgctcatctttggaattccgcaatataaggaatttattagtcaagtacttaaacaaaatgctaaaccaagtcatagcccaatttttatttatggtgtttttttactggttttagctattctacttttaattttagatatttttattgcaaatgatatctgaaataagaaattacaagtaaaggagattaattaaccatgaagatggtgaagatgggggggttaatttatcaattaacaaatccacagattaaagataaaatttgagccggtgaccgacttgataaacaaataagaaaacgcggaaaaatcggcgaactctgactaatttcagcaatcagaggttctgaatcactagtagatggcagctatccgctttcgcttttttatcaagaagttccggaatttttttgcaattatccaaaaaaaacctacccaaatctccataaaattattgatgcgggtcaacctttaagtctacaagttcacccagatgatcaatatgccaaaaaaaaatataactcacttggtaaaaatgaagcctgatttgttataacaagagggagaaaaccattcctgattggagcaaaatcacttgattttatcgaacatatgaacaaaatcactaatgaaaatattaatgattatgttaattcttatgcgcttcaaaaaggcgatcttgcttttatccctgccggaactatccattcgattccagaaaaaagtcttgtctatgaaattcaacaaacaagcgatatcacttttcgaatctatgactttgaccgagttgataaatatggcaaaaagcgaaaacttcatcttcaagaagctaaaaaagcaataaaaccggagctaaaacctgtaattgtcaagaaagacaggggagttgcgcgtcaattattacttaaaaatgagcatttccatctaactcgaattgaagttgatcttgaatatattcttcttcctaaagaagatgtctattgatatgaggttgttattcttgaaggtattggtataatggcaggaactaaattcaaaaaatttgatgcctttattatcagtgggcatcttaaaaagccgattttgtttatcgcgatgaatgcaattattttaatcaacgaagttagataagaagtttaattataccataaaaaaagttttcttaaaaaatgcaagaaaacttttttttttttttttaaaaaaaaaaaaaaaaaaaaaaatttactattattatttgggtaataaaaaagacccgtaataaaattacgggccctaatcctgagtttcccagtttgatggcgaaaattcactttttagtgaatatgaatatgcagaaatcgccgtaaatcggtgttttttacccgtaaaaccttaatttttattaattacaattaattacaattttaaagtaattttatggtataattataaattatgaaaaagcataatttgattttgtttaatgtttgaggatcttcaaaagataaaatatataaatatgttggctgaacacaaggttatgggaaagctccaaaacgttgatttagtataggaaatgtgcaaactttggaaaaaattaatccaaatgctattcaaattatcaaagaaaaattgaaattattttcaaatttagatgacaaagataaaatcaagacaactttacttgattctcttaaaaattctgccataatcgaaggttcggtttttattggtggggaattaattgaaaaacttattgaaaagcacaatatttttgaatcacttcctaaaagtagacataaaaatatgagacaaatttttaactacttaatttcaaagcgaattactgatcctggtagcattattaatgcttttgataaaaaggatgattactcaaatcaaataaatacttccaaaaatagcttttatagactcttagatcttgtctatgaatcacaaaatcaacttttagatagtcttaacaaaatggttataagcgagcttggaaaaagggacaatgaattttattttgattcatcaacagtctattttgagacatttgaaagaaatggattaagaattcctggctattctaaagatgctaaattcaaagaagatcaaattgtcattgctttagcatgcgataaaaatggcattccttttcatattaaagtttttaaaggaaatacagccgattctagtaccctaatcccttttgtattagatattgaatctaaatataatatcaaaaatatgacaataattgctgaccgtggcatgtccactgctgcaaatattcgatttcttgaatcaaaagaatataatttcattatttcttatcgtgcaaagataggcagtcaaaaatttaaaaattatttattagatcctagcgattatgttgatctaaatccagattttaagtataaaaaagaagaattttattcatcttataaaaataaaagatacactgaaaatattagaagaagaattattacttacagtaaaaaaagagcaataaaagacagcaaggctcgcgaagaacaaatccaaagttttattaaaaaacaaaataaagatggttttattgaagtaaacaaattgtttggtaaaaaacctaaatattttagggaaatttcaaacatgaaatttgaattagatcaaagtaaaattgacaaggacaaacaatttgatggttactatgtctatgaaacaaatatactaaatttaaatgtcttagacatagttgaagaataccaaaaacagtgaaatattgaagctaattttagaagtctaaaaggtttattgaatattcgtcctgtatttttaagaatagatgagcatatcctagctcatacatttttgtgctttatctcattagttattttaaaaactataatttttaaaatcaacaaacatattagtgataacaagttattcgcaaacagtcaattaactgaagttggtttagtaacgatgttgcaaaaattaagacaaagggttgaatttaacactttagatcaacaaatgatatttaaaaatcgcgatggtgttcctagcgatcccaatatttgaaataggtatgatttctactttgatatcttaataaatcagtaaaaaaataggtaattaacttttggcaaaaaacttaaaaaagcacggaaaaccggacacttttttaaaattatctcatcaaactgggaaactcggaaaaaaaaaaaaaaaaaaatttactattattatttgggtaataaaaaagacccgtaataaaattacgggccctaattttcactaatatgtaaaaaaaattacaaaatatttaacatatgaatttgaattatttggctaatttactttctttgcataaaccctaaaataaatagaaaagtaaattataaaccataataatactaaaataaaatatttagaataaaaagaaaggaggataaaaaatttaaaatttagatttaaagagaggttattctactatttttttagagatattaaactctttgaaaacattattaaaggcgttatttgtaaatgcgattgttttaacctgtcaaggagctacattaagattggcgacatcgttagaatctcctgttccgcgatagaagtcatagataaccgaagaattaatcactggaagtcataaagtattaggaccttggatctgcattaccccaacaaaacgtatattaccggaattaaacatttcttcagggataacaactttaaatttaatccatttttgcttgtctttatcttcgcttgatttttctgggcgatcttgctcctggactcttagcgcggctatttggttatcatcattttggaaaacaagccttcaatcttgtgttttgaaattcggcccattttggaaacctaatggtccgtattttcataaaggtaaaggagcatttgttgtaaggacaaatgtccttgttttttgatcaaagctggatttaagcgcttggagagcaaatccttctctgatcttctcccaggtaggggtctgcccctgggaattcatattgctgttttcattttctcaattaccaaaaaacactgttggcttataaaatttctcctttgagccgctaatatttggccatcattgagtaatatttggagcaattagttttgtattatcttcaagttcctttacatctttaataaagacatcagcaatgttagcagttataacatttggctgattggtaatgatatctttatcataccagaacgtgagatatgcagacccccagtcagcatagttattattaacttgcttctggattacttgttttaattttgctccagatccccgatctgagccttcaggttcaacaaataaattagtaataaaatcacttgaattatataaagtaacctttcaaggttgatttaaaactaggttaagataattttcaggtagtttttgatttggatttggatattctttttgatcaggatgaatatttgttcatcccttagcaattttaggggattttttctcatattcatttaaatagtttttaaataaatcatatgattttaacagtttttcttccccttttttatttgaagcatccttaatttttgctagttcatttccaggatcaaaaattctaattgaaagacctagtttaccatgatattcagtgtttttaagacctaaagcctgaataaaatcttgcttaaatcgcttttgaccgtttgaggaagttccgcccttgagttgttctgaaccaatataaccatcaaggccggttgatcagggaacaccaattgatcgttcaaccaaatattttggtttgatcattattattttatcagaatagttagaaagattagtattattatctcgtttaagagctatgagtgcgggggtaaaagtttcgggcttaatatttttattaagtctttggattagacccgagccttgattacccccgcctggttgttgttgttgttgttgttgttgttgagaactcacatttcctttattatttaaatatttatctatatttcttcagtcctcattaaaatagaaaaagggattataatcagcaaaagtaattggtgtattcattaatcttttgatattattagctcttagagaaaattctaattgatgatcacctgcttcatttttgattacttttaaatcttcaattttataatttggatcattatttactaaatttgataaggtaagacggtgagcttttgttaaaggattaagaatattaaactcgtcttttggattataggtttccagttcttcttcttttctaacagctttcttttgttgttgttgttgttgttgttgttgttgttcagtttttagaccaagctctcttattgttttaactaccgggctaagacgcaacatttgctggtgaatcaccaaaggaatacttgctagtcatttatcagaaatatttccgctggcatcaactggtatttgatctttgaattttaagacaaactttgtcttagccgcaagcggggttcttggatcatattgctcaacccatttagtatcgaatacttcgggagcagcactcatttctggtgctttttcaattgtagtattaacaattaatgacattgtctcatctgataaaactcgaatagtttttccgttgtcttcaagagtttttgctaatttaaattcaacgcggaaactaagctctgaaactttctcaacattgataatctcgaattcaatttctttatcattttgttgataatattggataaattgattccctaataaaattgccagtttttgttttaaaagacctgcttcttgattatctaggctcttatttccttgttttgaatcatcttgtccttcttggtctaaatcagcttcttcttggaaattagtactaaaataaggggactcgattattgaaccaaaagttgagacatttacattttggctttgcccgttttgatttaatttaccttcaaatcaatctttttcgggacttgaactaatttggggaattactggttttttaagtttatcatgaattaaagtatagccatcattatttagttttttaggtagtggtttttctttttgtttatgttgaactgctaaggaagttgctaatttttggaaaaccccaaatctttcagtatcaagataaaaactttgaagacctaaaggtgcattttcaactgcttgattaagttgatcaattgtatctgcttctaatttggatttccctgaggttttaagataaattgttctacttgaagaacgaattacttcttgattaaacttgccagcattatcatcaaaaccgattgcataatggaattttaattgataaacatcagctcctactttttcttttacttttggatctagctcagctatttcttcaaaaataatagttgactttgcccctgaatcttgataataatttcagttattagaaagagcagctgaggtataaaaagcagttaaaagctcttgtaaattggaaatttgtctaaatttagcatctaaattattttttggtttaactttaagtttatcacctagataagtccaataaagattatcgcgagttttgttaattcaagattcttgaagatcttttaaaagtttatactgaagcctgttattttgatcaaattcgttttcatcaccaatgattttttcccagattttagtactaaactgggctaactgatcctgattagatagattttgatctttaaattggctaataatttcttgttctcaagggctattagagttttgagaactaccaatatttgaactattttttcttaattcttttggtaaaaataaaggaagaccaaattctggggctttaatttcaccatcataataattattaaaatcaagtaaagataatttgaaattatctttttgactaaataaaggtgttttaatcctaatattcttaagatcttcaagattgaaatcagaaggaagattttcatatccttcaaattgaagacccgctttttgtcctaattttactaattcgtggattgtttgttttggatcaagacctaataaataacggtaatatccaaaaagtgatcatttattttggaaagcaggagaagcacttgaataaatctgccagtatttatttttttcggttttatctagaacaaattttgcattttctatatctctagagcttggaattcttggatttacttcaaaaagttgttcttttaatcttaaagaaatattataagtatgtctattggataaaagtttggctaatttggtataatctttggccttaattagttcttgaatttgtgattttgctagataataacgttgattttggacatcctttatcatataaggtttatccggacttgaacctaaaccggccttttcttgctgatattgaatcggggaattctcaggaagtctttcagtaatattatcatcttcttcaagaccatcttgattatttattgcttttaaattctcatctttttgctggctaaattctttaagaccctttttcgctttttctttttccaaacttgctctttgctctcttcgggcttgttcaagttcttcattaacacctggatataaaagtccaaaagctttttcgatttcaacatcacggaagttatctaatttaaaagttacttctttttcgaataaagttttaatattaggttcttgatcacctaaaattgaagatttaagactaattttgattggtaattcaatgaataatttttttgtaattgaactttgtttaatttttgcttttgaaactaaaaaagtataatcaagatgactggctaaatcatcaaaaagaaaattatattttcctaatgaaaaccgaagattacgagctaaagttgcattaactaaatctttaattgaattaggtttagaaactaattcctgaagttgggaataaaaacttagagcatcatattcatataaactaaatttctcaattcttggtttttgctgatcttttttaaatttaacccgatcttttaaagatctctcactagcagggacaggtttaacttgggaattactagtaattgtctctgattggcctccaaaataatcagagacatctaaaagatcaacatctaattgatcttttagatcattttcattagcaaataaactagttccattacttgcttttaaatcgatactacttaagaaagtctcatctttgtatttatagtcttttaaaatggttttagcctgaggactaaattcggttcgaagataaagtctgacggttttttgatcttgattaagatcactagctcattcttttccattttgcggatttctaataaaagaataaacaaaaggatcaactaaattgcctttttcaaaactaaaatcggctgtctgcaaacgaatatttgcttttagagcttcaagatcaaagaatttttcaagataaactcaaagttcgtcctgatttttaaactgattaagttttgctataaaatcacttgaacgggtcagtgcaagcggctttattgattgagcagaaaaattagataaaggatggataattaaattattaaaatttttatcaacgatataagaatattgacccagggccgctttgggcatatcaagtggtaaaagataaataaatttagttgctgattgagctatatttccatcttcaagtttttcttttagatgaaatccaagacgaaaacgttctttatcatcctcggggctaaattccgagataaccacctgatattttttcgggatctccaaaacggttctcccattattagtcaaaaagtcaaattttgagacaaaatcagtaaattctgaactttttggatcaaaggttttccaatttaaaagtgcttttttaacactttgataatcgcttgtaaaatttgcaatcgaaggtttaaatgcaacagaatcaatcagtcctaattgagatattactccttgagttggatttacaccccgatatttaacttttgaagccaagccaacaactgtcccaaaaacagttgaaccaataattgccgccgctgtggctaatagtaatgttgattttttgtttttcataaaaaacctccgggtttttctaaaatttttcctttttgtctctttgtataaattataatataaatttaaaaatttttatctaatttttactaaattttttttaaactaaattttccttaaaattttctaagaataattcttaaaatattgatccataaaggctttgcgcacatttagtcttgctttatcatttaagagtttatcgcctttaaataccgcaaaccctttaaaggtcatacccactcggtcttggggattagaagcttgtggggttgtatcaccgatctgtccatagtcaaatcctctacctaaaacagaagctagctcggtttctcagtttgtatcctggttttggtatttatttttatctttgatcttaatttcggattttcaaacttttagtttgctatcttctctttcttgttgttcaggaattatcgtaattgttgcactttcatcatcaattcttatttccattaatcaagtttgaccaagataatgttcaagtggttcgatctgatttggtttagtttgtctaatatctaaattgaaggtctcagcttctttattttggctattttctttagtttgaggcgatgaagatgcacctggttttgaatcttctaaaagaataatctcagttgatttatgtctaggaagatcggctacttgtggaggtaagatcttatcatcattaactggttttgccccgattagttttcagactaatttaaggttttcttggtatttggtttttactagttcaagattagagagtccatataaagatttaaaatgaacattggttgttgataaaagtttatagtttcttcctggagctgtctttgatccttttattcctaaaatttgttcaggtttaaatgctaaatataaaactcctttagtaagtgcagtttttcttagagcttctttggatgcttggaaagtataaggatcatttttttgatagtcatacacaagtgaagatttaagtcttagaccctgacttgattcttctgataaaggtagattatcaaaaagtttatgtacccgataggaagatttagtattattaattgaattaattgccgaaacaaattgccttccttgaagatatggcttgtcccctgtatcttgtttatattcaagaccggaagttccatcaaggaaaatatcaggagcataacgaagtgatttttcaagggcaatattagttgctgatataccatgtaattggaaaagggatgcagctacttgaatattttccttatcaagtacccggaatataacattatatgttctttggggcgtattatatcatctactaagtgataatttctgatctgggccaactttaaaagtttcaaaaatatcaagatatttaacaagataatcaccaaaggctaatttttcaggttcaatttctttttctgtttgttcattggtttgatctttttgatcatcttgaaaagttgttattttatgagtttggtatgaagctgaagatgatgctgcttgttggctttgaccttgtccagaatttgcctgatttgtctgggaattttgagcagtattttgtgtccctgaagactcattagtatttgaaggactagtttctgagctagtttgtttatctttttcttggttttgagtttgagtttcagttttttgctcagggctttgagaatgtttttgttggtcttgttcttttttatcttcttgtttttcttgttgtttttggttttgtttatcttcttgtttttcctgtggtttttggttttgtttatcttcttgtttttcctgtggtttttcgtcctgctctggttttttctcttcttctagtgggggaagaacttcttcttttggcgggagttttacaatggttatttcactaattggattaagtttttcttgaagatatttttttgaggcctgtttttcttcttgacttagctcaaaatatttatcaagtttagcttgagcaaaaatcttgtcaatgtctgttgaataaatttggtattgattatttttattaattccaactctgtggaaattaccaactaatttttcaagttcttgttgaattggattacctttaatatcaatatcaattggataagttcaaccctttaattcataagctgaataacgaatttctgaactaaatattgaatttgcagctgcagctccaactttaagatctaaagatttcccttgctcgactagttttttaccttgtttgtcaaattcaacatagtcgcctatctctccggcgtcgatatattgtttattttttgaatctacttctaatttaagattagctaaaggactaatttttaaattaaggcggattttatttgcatcaattacatcacctgcttgaatctgacctgtttttttagcaagatcaaactctaatttataattttcataagatgatcttttatttctaagatcaaaccaaaaattaatattatcaggaagaattactttttggttttgatcttttaaaagtgttctataatttcaaccatgaatttttagaatttcttttagctctgtttttgcttgatcctctaaattaattggtttttcctcaggttttgcttctggttttgcctgggattttgtctttgggtttgtctccgggtttgcttgctcttgggtcgcctttgtctccgaactagattcattagaagaattacttgcctctgaggtcttcgcagtactatgtgaggattcagtttgaggacttgccatttgttgggccccattagaagattgattatttgttgaagtagaaccttgctcggtattagaatttgttgttggtgctggtgtttttggtggtgtctctggtgaagcttgaattgttgctacattgtttttgccagaatcagaacttttacttttctgagggctttggcttgtctggcttggtttataaagttcctctaagaatttttctacttcattttgcccacgaagttgatcaaatttttcccttgaaaaacttcaaattacttcctgaattttttttcgcggattttttcttagatattcattaatctgaggtcttatagttaaataagcattctggtttctaaatatctggctaaatactttatctttgatctcgccaattgaagcaagcccgtttattggcaggattagatttttttccttcctatttttatctaataatttaagatgaattgatgctgttcctgcctggtcatctatatcaagttttattaatgatttatcagaagaaactggtaataaagtatattcatttggtaataagccttgaagtccggaagccgctagtaatttaaggccaccaaaatcttttagtgtctcaagtaatgcttgatttaatttttcattttcaaatactaattttttcacaggctcaataactggggctgcaacttttggtgcctcagctggtttttcttgagctggcttttcttgagctgacttttcttgagctggtttttctgcttctttaggcttctcttgcttttgatcttgtttttgttctgagccttgagtgctttgctgatcttttcctttttccttttcggacttagattccttttctgagctttgacttgtttgcgcggtttgatctgttgaacctgaggaacttccaccactggatcccccagatcctccagatccgccctcttgttgttgttgttgttgaaactcagtaattgaattagttagtgctctaacttggatagtttttgtttcttgaaaactttctggggaagtttttcttagatgagttagtaaaacatcttggaatttaatagaaaaagctgaaggtagaactatttcggtagcaaaatttttctttaattgatctttatcaagttcgtaagttgaagattcagcaacgaaattttcgataaaatcctcttttgcaacacttgaaaacccactaagacttgtatgaaaagctcgagtagctacttctttttttgtaattgcatcaaaaacaaaaacagttaaatttctaattgaattaccttcaactttagtattatcattaacctgaacattaaaaaatagatgcgcgaatttcttatcgattttggaaaaatcgattgcatctgttaatttaaaggcatataaaggatttttatggagttcaaaagcttgaccagctgatattttacttcagttttcttttaagctaaaattactgattatcttggataattcagtatcatttattggtgacaataattcagttgcagatttatcatttttaaattgattaagataagaggatctaagcgctgaattttgaacagccagacccactcccgcggttatcccaataaaactaagacctgctagaacgattattgctttgttgcgaatttgtttcttcataatgttaaaattataccaaaaagatttaaaatttttttatttttattttaattattttttcgaatttggaattctatttaaattataaattattttttaaaatttatattcaaaaagtttttaattttttcgttttttagtaagtcgttacctaaattttttagctattgaactaaaaaatttatccaaaaaaactaatccaaattagttgtttttttaaccaaaaatatgaaaaacaatctatttttccttattttttcctttttttttaaattttttaaacttttttcttaatattttttgaatccgccagcaatccgaaaaagtgaataagagtttataagcaacaaaactgataacacaattacaaaaaccagataagaaaaaaaatatgaactaactagcgtaatagcggttgtaataattgaaaaaatgctagaaaaaataattcttgctgctagttgaattccattttggaaatggaatttctcttttgtaaataaattataacttaaactataaaaagaaggcaaaaataatgaaaataaaacttgaacaaatataataattataatataactataaaattggaaatgcatattggcgcttttagggattataagtcaaataagatggactaaaattaaaggaaaaattagaaaattaatattaaaaatcttaccttttttatttgaaagtcaaaaatttataagagttccaataacagcggcaaaagaaaaagcgatattcaaataaggtcctcaaatttgaaaatcataataaattaaatttttttgatctaaatttattcctgaattaatgtatttaaaaaattgcgcaaatcctgataatttcggaatcataattattgaaattacaagtgatcctgaaaaaataaacaaccacttataaaaattgatttttgggtaattatgaattacttttttaggtttttcatctaacatactaaattcgattttttgggaatttagttttaaagaataatataaaaatcctgaaactaaataagtaaataaattaaaaattatcattcagtaaaattctaactttgtatataaaaaaagtccaaaaatagccgaaagcaaaaatcccatactagttgcaaaagtagacaaaatattaatatttaccatttgtttctgattttgggctaaaaaatagacaatattttttagataaataaaacgaaaagagtgaataaaacctaataaagtgttaaaaaaaatcaaaattattgaaaactgataagttttaatatctaaaccaaagaaaaaaataataagtaaaattccaaggacaagcgcactaaaaagatcagaaattagaagaattaacttatcattttctcagcgttttacaatttttgtactaaataaataaactattaaacttggtagttgaattaaaagatacaaaattgttactagtcaaaaatctccagtaattttataaatataaagcgaggatgaaaatttaaaagcttccgagccaaccaaggaaaaatttaatgaacttgtatatttacaggcgtttttaatgaaatttgtcattaatttccttgcaaattcataataaatagaaaaaattttttaataaaatttttgaattattgctatgaatttttgaagccggaattgatagggtaattgaattttgattctgaaaattggtaatatcagtagaacctgatccaaaaaagggtctaaattcaagcccgttttcatcaaaaagattttttactttttcataaatatcggaattataagccataaaaggatcggcaactcttatttttaccccctcaacatcccaattttcatcttcgctaacatctaaattaatcaaaaatttgtaattttcaacttcttgaattagctccttgtcctttgtgccctgaagttgaatttcttcttttgttgttaaaacgatatttgcatctgagataaaatcaacaagtgtttttagtactaaattggaaattttattatcgtgatttcgggcccaaattacaaattttgccaccttcaatttattttttggcagaatttggtaaatttctttgtgattaattttatcacaaagtaaatttgggcggttaatttttcgttgtttttcatcagaaaaaattaaattatccattttttggcagaaaatttgcccggttttttcaccatttttatcaaaaacctcaaaaattccactttctcaataagggcttccctgattaaaaacttctccgtttataacaattccgccaacttcgtcagtatgtgcaataaataaggtattttttttggggttattaagtgaaaaagttccaccttttgtggatttagtgatttttcctataagaatttttttgataaaaggttcttcaaaacccgtcaaggagggaaaatttagaaaatctgtcagtgatttgtttatttttgcaatgtttttttggattttatcaaaaaacattgcaagatcataaatactttttgtatttttgatatagtcaaaaaatccgtagataaaatcttttagatctggcaaaacattggttaaatacttatctaattttttaacatcaaagtgaatttcgagcattcgatcatagttataatataaataaataaaaaaagaatttcagctacttaccaaaaattcttttttatggagggaatattctaataaatttttatttctaaatttatttcaaaacatcaccaaatcggctattattgaagtcattttttgatggctattatgaggatagacatcatctaggacataagtcatcattagaatttttttaaaaaatgccgattctaccgatgtttttcaaatattctcccactctgttttttctaaaaattcttctggaattgtttctagtaaaataaattcaacatttatgttgttaatttttagaatttttaaattttcatcaactcgaatgggaacagcaaatttttctgctagtaaaaaagtgataaatttttgccttcaaattaaaggcccattcaaaaaaccaaagtctaaatcatttggaacgcgctcgattaactttttagaccagtgaatataacttcctttgaggaaaattcttaaatttagaccttcttttttgttaaattcctgcaaatatgcagcaattattttgatcgtttctgtcattttaggggagaatttccttgtcagtttctctcgggattagttgaacttcgcgtatatcattttttccaattaaaaatagcatcaatctttccattcctaaaccaaatccagaagtaatcatcggagttttttctttcatttctaaatatcatttataattttgtgggttatttttgtggtttaaaagggattttaatgtttcattataatcaaaacacctttcaccacttccaactatttctccgattcccattaataaatctgaattaatcgcaaaaccatctttacttttttgataaaaaggtacattaatttctggaaaattatctaaccataaaattttatcagaaaaataattaattaaaaatttttcaccttttgaatttatatttaaaagtagttcggttcgatcgatgccttctttaaatttttcatctaatatttttatagcatttgtaaataataaattatattgatcaaagtttagtcacttcaaaagtcttggtacattattttcattaaaataatttagttcagcggaatgtgttttaactaaatttttaactaaatattttagataatttataatcattttttttgtttcaactaatggtttttttgtttcaatctcaaaatgattaaattgatgtaaatgtctttcatcaacattttcgccacgaaatgttggggcaatatatccgactgattcaacattttttgttcttaaaaataattccaaatgaaattgcatgctgtctgctaaataaaactcaaaattcggattatttttcgaaataactttataaggtagtgaatcacttccgagccccataggacttgaaatactttgtgttgttattggacaatttactatttttacattgttatcgcgcattcacttgtatgttaaaaaattaatttctgaataaattgttaatattttggcataactttcacttgatatgtgctttataaaatcatgcttaaaattcttaaaattcacagttattgagtttccttttttatatttttttgcgtagtaaggaaattctaacaaaatttttagttttttaaaacaaaagcaaaatttttaaaatttttttcataaattagtatcaaacttaattattaaaaaataatttttaattaaaaaaaattaagatttaagattttaaattaaaatattaccaaaaaaaatgttctaaacttagttagagctgtaattttttaaaaatttttttcaaaatcacagctcacaaaccactttagctttgtaattgtcaggattttagttgtttttttgtcccatagacaaaatgatcctcagaaatcgcgaattcctcgatcacatttggatatttttgttcctctaaatattgattattaaataaaattggggtaaaaggaatatgagcatttgaaatttttggtactgaatttaacaaattaattgtataaggatggactgggtttgcaaaaattgccgaagtttttcctttttcgacaatttttccagcatgcattattaaaacttcatcggcaatatattcaacaactgataaatcatgggcgataaaaattagagaaagatttttttcttttactaatttttttagcaaattaataatttgggcctgaattgaaatatcaagtgaagccactggttcatcggcaattataacttttggttcaacaattaaggctcgagcaattgcgattctctgtctttgaccaccggaaaattcatggggataacgataggcatatgatcttaaaagattgacgctttcaagtgcttcataaatcaattcgcttaaaacaaatttgcgaattgattttttaagaaagaaaaatggtttggttttcattccatagaaaagttggatatttttataaatccgatttaaattctgctgctcaaaaccaagcgatttaattattgccgttttttcaagaaaacgactttttaaattagcaattaactcacgaaaatcgtgtttgtgagctagttttgaaccaaaaactcgatgaactagtttaattctttgctcatatgactggattttttcaatgaaattagtataatttagcttttcaacattgattttttgctcttgttttgttttccaagaggtatattttctaataaaaaggtctttttcttcttcataaattgcttctttttgggccagtttttcttttaattcattgagtttttctagattttcggcttgcggactacttctttttttattatatgaatatttatttttaaattggagaaattttgtttgaaaatttactttttcttgataagtttttttacgattttgggcaatttcttttaaaccttgaatatccaaaatgataatttcggtacggattaattgactaaataattttgtatttgtataatttttttcatcttttttatcgaaagtcaaatttttatacttttcaatttgactttttttgaaattattcataatttcaaataatttttcaatctcagaaatattaagaaaggaaaaaaggtttttttcaagtaacaaaatatttctcctatcaagaaatttggcaatttccttattgattattgcttgttttttaaaaaatgaataattttttagatctgttgttactagcgctttgttatttgcaattttatattcataattaaattcgtcaatataggaagtcaacaaattgttttgagcggtgaatttgtcaatctcgagttgggcctctttttttaaattaagcgcttttacatttaatgttttaatgaaaaaagctttttcttgctttattttttttagctggtcttcataatcttttttagcactgcggtagtcaaattcgacttttgcttgctgtttttgtcggtaaattttttggacttcatagaaataatcatataatttggccacattttcatagccaagattatatgatgagctaaataatttttgtaatttttcaaaataaagcaaataagaattaaaaaattcgttgatttttgcctctgtgattttatcggtagaaatttgcgctaaattttcttctattttttcaatccgagattgccagaaattaatgaaatcttgaaattcaaagttacgtttttcgagcatttcaagttcaatttcaagatatttttgttctaaagttttggcaaaatggaaaattagatctgatcagtcaaggaaaatatcatccatttttgacttaattattccgttaattaccaaagtttcttttagaatggaataaacatttttctgtttatttagtgaagaaaatggatcttgaaagatcatctgcatattttttcttaagaaaagattctgtttttttgatagtttttttccagaaattacttgatttaaaagttgaacctgacccccaaaattttcataaaggcgaacaagacaacgaccaatcgaggtttttcctgaaccggattcgccaattagtgctaaaacttggcctttttttagctcaatatcaattccatcaacggctttaatagtcccaaatttgtttgtaaaatatttttctaatttttttgtttcaagagcaatttccattataacacttctttaaataattttattcttgtttttagttcttgatttagttcaacttttggagctttaggatggagcaatcaagttgcagcttcatgagtctcagaaattggaattagtggaggttctttttcaaaatcaagtgctaaagcatattcatttcgtggagcaaaaggatcgccggctcctaaattttttagatcagggggagaacctgtaattgtatatagttgattttctttgttagtcccttcaggaatcgccgaaattagcgctcatgtataaggatgtcttggatctgtgaaaatatcttggcgggttcctttttcaacaacttttccggcatacattatataaatataatcacaaaattttgcaactattgaaatattatgggaaataaaaataattgcaattttatatttttccctgatctcattaagtaaggctagaactgaggactgaacagttggatcaagtgctgttgtcggctcatcggcaataataattgaaggttgctgagcaattgtcattgcaattacgattcgctgtttcatccctcctgataaagtatgaggataagaattaaaacgtttagtagcattttcaagtccaaaagattcaagtaatttaatcaaaaagtctttcttttcttgaatatttttaaaacggctatcattttttagcgcatctaaaagttgtttaccaattgttcttgtcggatttagtgcaacaagtggatcctggggaatatagccaattttatgtcctctaatttgtcttcattgcttatctttttgaaaattagttacatcaattccatcaatttcgattttatctgcgctggttttagcaaaattattaattcctaaaagtgcttttgcacttactgattttccagaaccagattcgccaacaaaggcaataatttgaccctgataaagacttaaatcgatccctctgattacttcaagatattctttttttccagttttaaaactaattcggagattttttacttctaaaatccgctttttttgctgattttccattattttcttcccccaattcttggatcaaggacatcatggattccatttgcaataaatcgagaagtaactgcaagaattactaaaattattgaaggtaataaaagtgccattggatttttattagcaagtgaaactgatgaattaataataagacctaaattaggacttgaatcaggtccttctttaataaatcctaaaaaagcaagcgcggcaactgttgtaattgaagcaaaaatacttgcaataaaaacagataataatttcccgaaaatattagggagaatatgatagtaaatctgacgtaattttgaagccccaattactttagcagcatagacatattcttcatctttgaccattattgtatataatcttgcctgataagccggtctagttcaacctgtaagtgataaaagtagaatcaaagtgagagtattaggaccaaaaattgcaataaaaataataaataaaataattcaaggaattgatccaaaaatatcaataattcttaaaatcacattatcaattcaggtgccaatatgaaatccaaggtaggtacctaaaataattccaattaaaaattggattagagcaattataattgcaattcctagagcatttaaagttccttgtcaagttcttagtcaaatatccctaccatattgatcggttccaataattgagacaaattttttcccattttctaaaattgacattacctgataaggatttatttgaatctgccagcgatttgggaataattcaattgtatctcctttaataagttgaattttattttcaagttcaattgacctaattttttctaaaatatccgtggataccgttgtttttataagacctcagccacttggaagttgctcatttacaaggacaggatcggcttgtgaaatcggttttgttgaactataaggacttaaaattactgaaaaaattgcaataattaaaagcgataaaaataaaattgttgaaatcagcgaaattttagagcgaaaaaattttagaattgcatcttttcaaaactcaagtattcttccggttgaaatatagtttttctcagaaaaacttgcaggttttaaaagactaatttgctcttttgttagattatagcgctggctaaattcttttgaactaggcattatttttctcctttcttggataatttctgattttccaatttttaattttttctcatagacttattggtgatttattcccaaaactaattcgtggatccatgaaaagatagacaagatcgccgatgatatcaacgattaaagaaagcgaggtaaagaaaataattgaaaacatcgaaatattaacctcgccatcaaaagccgcgcttactaaaatacttgaagaccccggaattctaaaaaattgttctaaaacaattgatcccgaaaggagaattatataagaaaaaattagcgatcttacaagtggaattgctgcatttttaaggacatatttaaaaaatatgtccatttttgatagcccttttgctttggcaattaaaatatattcagaagataaaacggtaattacctgatttcgaacaagaaaaacataacctgcaactgaggtaatcgaaaagacaaaaatcggcggaatcagcgaggctagtgcagttgagatcccataagttgaagggtctttgaattcaaaaggaagaccaattttaattgcaattaaaactacaaaaggagctaaaacaaacgaaggaattgctacaaaaaaagttgagatcccactaattgctgcatcttcgatccgatcgcggcgataagcagcaactgttccaagaataactcctagaaaagcactaattaaaaaagatggaagagaaactaaaattgtataacgtaaagggccaaaaaacaaactaggaatttgaccatcttcaccggttttataaatcgggccaaaatttcctttaaaaacttctgctgtataaaatcaaagtcgggctaaagttgattgatcaaaatggtattttgcccgtaaatcagcaagttttttcccttgatcggctacttttgatcctttttcaactaaatcaccaaaaggatcaggagaaaaattagcaagtaagacaaaaacaattatataaattgctaaaaatgtaatcaaagcaagtaaaagccgtttaaaaaagtatttcagcgccattatttttctccttttttattatttttttcccatttttcttttaaaggtttaatgacaatcatatctgggggtgtaaatgcatcataagtatcgtttgcattgggaatttccaagtttggattttgtaaaattgcataaggggtagaagaaaaaacgctgacaagatcgctaaggccaaaacctaaaagcgaggtaagttcggcacttaattcaacaagatcctcatcagaattttcttcttgaaaagtcaaattaaaaattgctgattcagctagaaaatcaaaatcaattaaatcacctttatttttgtttttagcattaagttcttcgacaaagtttttccaaactttgattttttttcctggattttctggatcatcttcttcgatcacagacccaattatataatttgttaaatccggggaaaaatgttgattatgcgcgccaaaatcaggggcatttgtagcatcttttcattcttcaaatttgcgtattcaacctttttttgcaaatttatcaaaaaaattttttgctgcaagggcatatttataaataaggggataagattttgcaatctcagaattttcgcctcttagataaattgctgaaagcattgcatagccaatgccgtttctttgaatttttccatctaaaaccgttccgattccgttatagtcataactccaaccgccaaaatcaagcccgcccgtgcgggtatataaataatttgagcgtcttgcaaggtcagtaattggtcagattcgcttgattttaagtcggggatcgagactttcgattgcatcagcggcattatttattgctgcaattgttttacttccggtatcagtatataaactatgactagttcattcaactttttcatttgggccaagtttgttatcctgtcaaaatttatcaagaatttttttcattctttcttttaaaatgtcaaaatttggtgcttgaaattgttttttgccgttttttacattggcaaaattttgttctctttcggatttaggatctttttgataataaattttacctgtagcatcaactaatttaattgtatttactttttggtaaaaatcacggggtgtttttgattttggatttgaatttagtttattatccggggagataaaattatatcaggcaagttgttgggaggtaattgcttgtgaggttgtatataaatttcaagcattagcgattatctggcggaattccaaacttggacctgaaatcaagtgttcaataattttagcactaccctcagcgatttctttaaggggaacaccaaaatttaatctagcaaaattatcattgaatccatagtatttctcatcaaaactcacacccgtttcggccttaaatttctgccttagagagcctggaactaaaagagaataataccatttatgaaggtcgtttttactttcttgccgatttagtgttcagccaaattttgcttgattatttgctaccaaatttttctgggactcactaagactatcaaaaccgattgcattaattgtctgttcgcgataagaattaaactgggaatctgcaaaagcagaagcagatggatattttgaataaagaacattaattttcttaaaaatataaggaaaactttcttttcaaccagtccggggaaaatattcattgatcattcaggattgtttatgttgatcaaaaactgttggaagataaggtgaattataaagtaaatcctttttaaaatcctggccatatcaataagccccgaattttaaagcatcgcctgtttccccaaaacggcctactaattttccatctttttcttttgcaagttcttttgttcttttatcaataaaatcggaaggaactggtctaagcatccctgaaagaacgattttatcaataaaaccattgaaaaaaaccttttctttatttgctcctttttgaaaagtaagtgctttttggcctttaaatttttcaagactaccttgatattcctgaatatatttattttcatcatctaaatcttttggatcaaggccaaaaagttcaaggagataaaaattagtaattgtattagtaaaataatttgattttggatcataattaggaattttttcctgtgctaacttgtcaatttctggacttccgccaaatttttcgcgctcacttggaaccgaaagtcgctgactgcgaaacccatagaaataatcccgcggttttagataatatcctgaaggttttccatcccaagtaacccagtttatttgatcttttagaaaaaactgaacttttttcgctttttcaagcgaagcagcaaaaaattcggaattaattgaattttttgctgctgaagtcaattttattactaatgacttcggtttttgacctggttttagataacctaattcatgttgatcactatcaaaaactagttgagttccatcattttgagtaaccaaaattgctttaatattcacaagggcatttcaggaatagcttggttggcttggttcatatataaatcgcttgtcttttttggtttgatcagctgctaaaacaccgtttttttcaatttttagttcattttcataaactgtttggatcaaaaatgaattattaaaataaagttgtgaactagtcaatggcgatgtgaaagtgttattaaaacttttaaaagccccaggtgaagaagttgcgctgttaacattaatattaaattcctgccgctgccaggctggctgaaccccgcaggataaaaaactaactaatgaagtaatacttaaaactgagccaataaatattttacccacttttttctccttttttttttttttttttactaaaaaaataaaaaaactactattttgaatagtagttttaaattttaaatggtgaatttactatatcaaaacaaaaactactattataaataaagcaaaaatctaacattaaacttgcgaataatgttattttttactttatatttataagtaaaatttgtctgcattgtatttcctgtaaagctattatagcactttttttaaaaaaaccaaaaaatttcaaaaaattttttttcttggtttttttaaattttgttttataatatttaaaacaaaaattgaaagagtagtaaggccagcccaattgcaatttttgcttttatatattataaataaggtggaattataattttatattttccccgccggaaaaatgatcctaagccttgcttcagctacttttgtaattggggtttctttttctattaacgaaagtatatgtaaaaattctaataaatcaaggtaaaaataaaaaacctttgtttttatagtgttttttaaaatattatctttagaaacaaaaaattaatgccggttttttagaaaaacccataaaagatttttaaataaaatttcaaaaatcttttatgtttttaaaattattaaaaaaaattatatttttgttaataattttaaaaaaacgaaaagaaccaagaaattactaagaaattaaaaactgcttttttaattaaaaatcgcaaaaagcacttaaattacagcactttttttacttttagaattttaggacaaaaaaacaaaaaaatttttttaaatttcttattttttttgatataatttaaattctaaccgttttggatttttttgaaagctttgatttttattttttgttctttgagttttagtttttccataacattaaattatgctaaatgaaaaatttccttttgtttggccgtttttaatatataattataatgtatatttctaattatgaaaaaccttataatttatagtatattttaataactagggaaaacaatatgtcaaaaattttagcaaccccaaaagcaagagcgatggcaaaacatgctaatattgatcttgctgatcttaaaattcaacatcggaaaattgaagcttccgatgttgaaaattacataaaatccttaaaatcagcacaaactagtgctgaaaaagtagaagtttcatcgtctcagcaggctgaaaaaacttctattcccgcgtcaattccgcctaaattagaaggaaaacgcgagaaaatcgctccaattcgaaaagcaattgcaagagcgatgactaattcttgaaattcagttgcctatgtcaacctcgttaatcaaattgacgttagcgatctttgaaaacttagaaaatcagttttagaccctgtcctaaaaacatcaggtgtgaaactaacatttcttgcttttattgccaaagccattttgattgctcttagtgaatttcctgttatggcagcaaaatatgatgaagcaacaagtgaaattgtctatcctgatactttaaatttaggtcttgctgtcgatactgacgccgggcttatggttccagtaattaaggatgctcaaaagctttcaattgtagaaattgcaaaagaaattgttcgtcttgccaaagctgcccgtgaacgtaaaattaaaccaagcgaaatgcaaggtggatcatttacaatcacaaattatggatcggttggttcactttatggtgttccagtaataaattatcctgaactggcaattgctggagtaggagctattattgattcagccgaggtcaaggatggtcaaattgttgcttcaaaaattatgcatttaacagttgctgcagatcatcgttgaattgatggtgcaacaattggtcgttttgctgcaagagttaaagaattattagaaaaaccagaaattttaggaatcttataatgtataaatttaaatttgctgatatcggtgagggactacatgaaggtgttgttgcccaaatttataaaaaagaaggggaaacagtcaatgaaggtgattcgcttttttctgttgaaactgataaaataacagcggatattccttccccaaaaaccggaaaaatcgtaaaagtcttaatggcagaaggcgatacaatccacgtcggtcaagaaatttatcatatcgatgatggctcaggagctgaagctgaagttgaagaagcaaaacctgaagccgaagaaaaacccgctggaggagccagtgttgtgggcgaagttaaagttagtgatgcacttttaagctttgattttggaccaaaaaaagcaaaaactgcttcagcagaaaaagttttagccgcttcagattcaaaaaaagttgaagacaaaattgaaaaacctacaaattcaggtaaaatttatcaaggtcagattgaaaaagaatttgatgtaattgttgtgggttctggacctggaggttatcttgctgctgctgaagctggaaatgccggactttctaccttaattgttgaaaaagaattttgaggtggagtttgtctaaatgttggatgtattccaacaaaagcaatgttgaaaaccgccgaggtttttgattatcttgatcaatttagtgattttggactaagtggaaattctgatcttaaaatttcctgagaaaaaatgcaccaacgaaaaaccgaggtggtaaataaattagttgggggtgtcaaggcaattgtaagatcggcaaaagcaacaagtatttttggtaaagctgaatttgtcggggcacgtgagattagtgttgatggtaaagtttatcgtggaaaaaatgtgattttagcaactggttcagttgatcgaaaattaaatctacccggttttgataagggttatagatctggaaaaattattacctcaaaagaagccattaatttagagcaaaaaattgattcaattgtaataattggtggtggggtaattggtgttgaattcgcccaaattttttcggctgccggaattaaggtaacaattttgcaaaatctgccaagattattagcaaatctagatagtgaaatttcgcagataattactaaaaatttagttgataaaggtgttaaagttattacaaataccaacattcttcgttttgaggatgatcaaattatctatgaatttgaaggtaaaactgagttaattaccggtgaaaaaattcttgtaagtatcggtcggcaagcaaattctcaaggtcttgctgaggttggaattgaacttgatagtcgtggtagtgttatagtcgatgatcaatgcagaacaaatgttgatagagtttatgcaattggcgacctttcggctaaggcaatgctagcacatgttgcctatcgacatgcggttgtttcagtagcagcaattttaggtaaaactgaaaaatatcaagaaaaaacagtacctgcttgcgtttatacccatccagaaattgctgtggttggtttaaccgaagaacaagcaaggcaagccggccatgattttgtcattggaaaagcaagtttttctcatattgggaaagcaattgcttctggaaacgcgtacggatttgctaaattaatcattgataaaaaatacggggaaataattggtgctcacattatcggcccggttgcaactgatttaatttcagagatcgtaatcgcaatggatagtgaagtaacagtttatgaacttgcagcggcaatccacccgcatccaacttatagtgaaattatttgagaagctgcgcgttctgcagttacaaaattgaagaaaattaaataaattataaaaaattcaatttggttttaaattcttaaaaacgatgtaaaaaacttttttgttttacatcgttttttttaaattaattttagcgcagattttttactttaatttgaaattaagttaaaaatgaaaaaacactataaattaatatactaacttaaaaaaaattaggtttttgttttttttaataaaaacctaattttttgttgtataatataaaataaattaaatttaattttcccaaacgctgatcgcatttttggcaattaaaagctcttcgttagttttaattacaaaaatatcaagatcggattcaggagctgaaattttctcaattggtccaaattctgggattggttttaagtttttttcttggtcaagaactaaatttaagccgggtatttgaactttttcgattaccagggaccgaataaaagctgaattttcgccaacaccacctgtaaaaacaagcgccttaatgtttttaccgaccttatttatataatttacaagataatcaacaattttttggacataaacttcaagggcaaaacttgcctctaaattaccactattttttgctgaaattacatcgcgaagatcagaagatacccgtgaaagccctaaaagtccggaatttttatttagtaaatgatcaatttcgctaaaagaaaaacttgcctcatttgccaaatatggtataattgatggatcaatatcaccgcttcgagtccccatggcaaccccggctagcggtgtcattcccattgaagtatctaacgactgtgaatttttaattgcgcagagtgaaattccattaccaatatgcatattgacaaaatttaccttgtcagagtcataaattttttcaacttgtgtggtaataaatttatgagaaatcccgtgaaaaccgtactttctaattccatatttatcagcaatttcggcattaattgggtaggtataattgatttttgggatagtaccatgaaaggcggtatcaaaacttgcagccagttttgcatttggaattaattctttaactgctttaattgttgccagggcgccgggattgtgcaatggcgcaaattttgcagctgcttcaattttggaaattgccatctgatctaattttgccggagctttaaaacttgccccaccatggacaattctaaatccaacaagttggaattcttcaagattttcaacaagctgattttccttccaaaaggcaatttggactgctagtgcctgactgtgatttgcaaaattatctttgtatttatagtcttttttgccaaaagacattttgattagaccatcttcaagaccaattctttcaattaggcctacacctaataattcaagattttccttttggaaaatctgccatttaattgatgaagaaccagcatttactactaaaatttttgctttcactatttaccttcttcaacttgtagagcgctaattagcacggtattaaagacatcttgagttgttgatccccgggataaatcattaattggggcattaattccggtaattattgggccaattgccccaaaatttcccaatctttgggcaattttatagccaatatttcctgcatcaagattcgggaaaattaaaatattggcgtttttacctacatttacttcatatttttggcggcgaacttcaatatcaagggcggcatcaagctgaatttcaccataagcttcaattggagatgttgcattaaacatttgcgtcgctttagccactaattctgactgcggtgattttgctgatccttttgttgaaaaggaaagaaaagctggttttggatcaaaacctaactgaatagcaaaatcaagggcatttttagcaatatcaacaagttgattctcatttggagcaatatttactgaaatatcactaaataaatatttttcctgatctttatgcataatcattactgatgaaattgtttttatatttggttttgggccgattattttaaaagctgcgcgtaaaatttcggctgttgggtaattaagacccccgacaactgcatctacttttttctttcttagtagcattgttccataaaaagcatttgattgaaattgaatttcggctgactcaggagtttcttttcccttgcggaatttaagaaattccttaataaattccattttttcttgaaaattaactatatgttgatcaacgtcaagatttggaatttcttcatcaactagtaaaaccggttttactaaatttttttcctttaaaagttttgccgcggcaattgctcgcggatcagcgccatcaataattagaactgagcgtaaactttttgtctcattttgttgctcaagtcttgcttgaagatattcttggtatgtcatgttttcctttcaagtcctagaaaattaacttttaaattttaaatcaagtataattttatacttttttttcgaaattttcataaaaaagctttaaaaaatctattgcttatttaagaaaattaatcaatatcttcgataaaaccaaaatttagatcattaggtcgtgtaaatttatttttcttttttagacaaatatataaggtatttttaaaatcatcatcattttcgaaattttcaatttcttcaaaatcagcaagtccaattgttaaaattttataataggattcaaaatattccctaaatattttaaaattcaaaacaatcataaaagtaaaaaatgtagcctcaaggatgataaacacagttaatccaagatttttatctataaaaattttactaaccaaatcagttttgagtcaatttgaggcaaaagtataaaataattcctcgataattgataaggttataagaataaaaaagagagcgaaaaatgatcagccaagaaatgacattattgccagatttttattcatcgacttaatctcttcaaaataattgaccttatattcacgcagtcggaaatcgtttgcataaggttttccgtcttttattgaacattttttaactaaaaaattaaaaatttgttttttatttgaacctataaataaacccagaggcataatacttaataagtcaaatccagcaactttttcggtgtttttataattaaattcttgaaattcttgccagaaattattgctaattaagaaatttttcctcacattttcaggttcgaaatggagagataaaccagaaaataaaaaattatttttcttaaagatacgtccaccttttaaaataaaaaataaagcaaaaagaaaaaaaataattgataaagttcaaaaaattcaaagaactttatcaagatttttaacaaaaatattaagatcagctattttttctccattgttttccagtcagtttttaaaatttatctctaaaaatagacctattcctaaaaaataaaaaaataagcttaaaaaaaatacgattttaagcaaaattaacttattttttttaattttccggtgaaaaaataaaacatattttctaatctcttcacgttttttcatattgttaatagttgtttttcaattgacttgttattaccaaattagttaaaactgaaatagctgagactaaagtatcaagaatacttattattgcacctaaaggatttgcatattttatcgttgttagaacaccgcgttttaatttccctgcaatttttagaccatcaactattttatgagcagaaaaaaatgcttttttaaataatgattcagtaacaagatcacgtaatactgtatttgttatttttcttcctagtatttttgaaaccattactttcattaccttttcaattgtagttttaattaaataacgtactgcagatgcttgagttgatatatttatgatattataaaaaaagataaaatcagggtctttattcttcaatttggtttttaattcgtctttaaattcttcaaaattcatcttttatttttgcatcgtttagaaaatcatcaatcaaattctcttgttttagttttgttgtttttatatttgtatcagttttttgagataaaattctttcattttttggtggggttggcgggtttttgtgtttttcaggatttggttctattttttcttggatatataaaacattttttgggtgtatatcaagttcaaaactagaacttgtatattctaaatatttatctaaaacttctattggagttattttttttagttctaattgcctctaaattatcataatgatcaaatttaaatcttgtttttaattgcaaatcatcaatattttctaaactaaaatttaaaaaattttctattcctggataatcgtcaaaatcaacattttcaatatttccctgcatttgtaggaattttttttcaaattctttctgcgcataagcgccatcagaaattgacatttttaccggggttatttcataaatttcttttggcaaaaccattgcaggtcttggatttcttccttgaaaaatatccatatttgcaacttgatagacaggggctaaaacccctggaagttgggataaatcacctaaattaaatagaattttcttcataaatcatcccattatttataatttttgctagttgatcaagctgataaaatttcttttccatttcttctcctagcgccttaactatacctagaaaagaattattttttgaataaatttcaaaaatattaaatccgagatttggacttcaaaaatagattttctcttctttttctcttcagaatttaaaccctttattttctaaggtaatttttagattttcactaaaaaaatttttgtcaataattaaaaaattttcattatcacaaacattaaaaccgaaaggaattatactatgctttaaataaaaaacaatattttttgaagttgttattttgaaaaatgtagaaatatacatagtaccaaaacaaaaatcatcaaatacataatctaaatctttttccttaaccacagatcaatattcttggctaatatttttgatttttaattcgttatttgatgctaaaatttcaaatttttccacgttttcaaataaaaaaccgctctggtgaaccattttatttatcgatcaagaattaaaatcaaaaacaaatttcctttcacgataaaccgtttttaagaaaaaacaaattaaagatgaaaaaaatgccactataccagaggaaagagcagtatataaaataatgaaaattacattttcttcatttgtgccagaatttttaagaattagtacattaaaaagtagaacaaaagttattaatgtaaacattaccgcaattcttaagaaaaaattaaaagttttatctattttttttaatcgaaatccaaccagcataaatctttgtcagtatttatcaagtcggtattttttcattatttctactaaaatattatttgaatttgtattttccataatctaaaattttacatttttttataacaatttttaaaaattaccctttaatttatagtatttttttattttttagtctaaattataaaattatcttgaattttatttgaatttttataatttagtactaaaaaatacaaatattttttcctattctaagaaaaattcattttttaaaaaaaattgatttttatagtataatttatttgtataattgaattaacttgatttgaaagggaacaaaatgaaaaaaatgcttagaaaaaaattcttgtattcatcagctatttatgcaacttcgcttgcatcaattattgcatttgttgcagcaggttgtggacagacagaatcaggttcgacttcagattctaaaccacaagccgagactctaaaacataaagtaagtaatgattctattcgaatagcactaaccgatccggataatcctcgatgaattagtgcccaaaaagatattatttcttatgttgatgaaacagaggcagcaacttcaacaattacaaaaaaccaggatgcacaaaataactgactcactcagcaagctaatttaagtccagcgccaaaaggatttattattgcccctgaaaatggaagtggagttggaactgctgttaatacaattgctgataaaggaattccgattgttgcctatgatcgactaattactggatctgataaatatgattggtatgtttcttttgataatgaaaaagttggcgaattacaaggtctttcacttgcggcgggtctattaggaaaagaagatggtgcttttgattcaattgatcaaatgaatgaatatctaaaatcacatatgccccaagagacaatttctttttatacaatcgcgggttcccaagatgataataattcccaatatttttataatggtgcaatgaaagtacttaaagaattaatgaaaaattcgcaaaataaaataattgatttatctcctgaaggcgaaaatgctgtttatgtcccaggatgaaattatggaactgccggtcaaagaatccaatcttttctaacaattaacaaagatccagcaggtggtaataaaatcaaagctgttggttcaaaaccagcttctattttcaaaggatttcttgccccaaatgatggaatggccgaacaagcaatcaccaaattaaaacttgaaggatttgatacccaaaaaatctttgtaactggtcaagattataatgataaagccaaaacttttatcaaagacggcgatcaaaatatgacaatttataaacctgataaagttttaggaaaagttgctgttgaagttcttcgggttttaattgcaaagaaaaataaagcatctagatcagaagtcgaaaacgaactaaaagcaaaactaccaaatatttcatttaaatatgataatcaaacatataaagtgcaaggtaaaaatattaatacaattttagtaagtccagtaattgttacaaaagctaatgttgataatcctgatgcctaaaatttctaaaagttaaaaatttgatcttattttattaaaaattaacataaaaaattagcttaaattttatataatttacctaataaaatttagagctaattttttatttatgaaaggatattaaattgaaaaaaactaatattctatcactaaaaaaaataaaaaaagtttatggtcctgtaattgctctttctgatgtgacttttgttgttccaaaaggggaaataactagcctagttggtgaaaatggcgcgggaaaatcgacacttttaaaaattttatcaggagtgattcctgctggacaatatgaaggtgatctaatttttgaagataaaattatggcttttgcaaatacaaaagcctccgaacgtgtcggaattgcaataattcatcaagaactttcaatttcaccttatttatcaatttgcgagaacatgtatatcggtaattatccgactaaatttggcaaagttaactgaaataagatgatttccgaatgcaaaaaatatctagaaatggtcggtcttgatgaagatccaacaacaattgctggctctctttcgattgcaaaacagcaaatggttgagatcgcaaaagcactttcaaaaaatgcaaaactactaattttagatgaaccgacttcctctttaaatgatgaaaatgcttttcgcttacttgatattatgaaaagtttaaaaagtaaaggaattacttcgatttttgtctcccataaattaaatgaagtcaaatatgtctctgataatattgttgtaatccgcgatggtaaattcatttcccagtataataaaaatgaagaaataattgatgaaaaccggctaattcaggacattgttggccggcctttaaagtccaaatttcctcctagggatttagatcgaaaaatcggggaaattatttttgagatcaaagatatagttattcctcatgctagtattgcaaattataatgttgtcaaaaatgcttcccttgatgtaaaacaaggcgaaattgtcggaatttccggacttgttggatcgggtcgaaccgaattaatgctttcactttttgggcagtattataacaaaccttcaagtggcaaagttttctataaaggtaaagaagtaaaatttactaacacaaaacaggcaatcaaatcgggaattatgtatgcttccgaagatcgaaaaaatgttggtctaatccaaattttttcgattcaaaataatatcacttccgccgctttgcatttattttcaaaatgaggaattctaaataaaaataaggaaataattaatgcccaaaaactaaaaaaagatgtaagtattaaaacaaaaaatattctaaataatgtcgaatccctttctgggggaaatcagcaaaaagttgtaattgccaaagctttaagcaccaaatttgaccttctaattatcgatgagccaacaaaaggtattgatgttggctcaaaatacgaaatttataaaattttactagacctttcatcacaaggtaaaacaattattgtaatctcttcggaaattgaagaacttttaggaatcaccgatcgaatttttgtcatgtcccagggaattatcaaaggtcagataaaaacttctgaggcaaatcaagaaaaaattatgcaactaagtattgggggtcttatctaatggaattttttaataattttaaaaataatttaaaagattttgcaaaaccagttaaaaattatctaaatgagacaaaaagtggacattatcttcaagccagcctccaccatctaaaaaaattttcaatgttatatatttttcttctggtttttgttatttttttagggattaccaaaggaactttattacaagcaaatacattcacccttttatttcaaaataattcttatattattattttggcaatggggatgctacttgtaattttaagtggaaatattgatctttctgttggaactcttgtcggtcttttaggactattttcggtttatatttataataataccggccaaagtatttgactaacttttatacttacaacgctaatcggggctgcaattggttttatccaaggctgacttattggttatggaaatatcccggcatttattgtaactttaggtggatttcttgcttttaaaggggctcaacttgtctattcaaatggggcaacactgactccaattggatccgttgattcaacttatattaagggaacaattgaaggaatccctgatctaaaagtagggaatatttgaattttttctttacttttacctctaattttaggcgcaattattgttagtctgcgaacttgaggatattatacaaaaagaaaatttggcattaaagttcaaaatattattatttttacaataattcaagtaattattttttctttattccttgcttgtggtataatattttcacttggagataaatcaatgcgttactatgttttatatgtaggtattgcactggctttatttacttttcttagccaaaataccgcttttgggcgctctgtttatgcaattggtggcaaccggaaagctgctctattatccggagtcaatgttaaaagaacaacaatgataatttttattatcattggcgcactagccggattttcttcgattattttcacagctacttattcttctgcgacttcttcgcgaggtgatgatcttgctcttgatgtcatttcagttgtctttactggtggagcttcagtctatggtggaattggatcggttagtggaacgatattaggaacatcaattatcggggtaatcaaccaaggtttgcttgttctaaatgttgccgaatcacaaaaatacataattaaaggactaattttagttgctgttgttggatgagatgttctctcaaataagaaaaataactaaaaaaatctttaaaacaaaagaaaataagtcaaatttttccttttgttttgcttgtgaaaaacaacaaatccattttttcaatgaaatttttattgaaaaaatggattttaaacttgttttacttgaaaataaaaattatgaaattattaatttaaattttaaatacacaaaatcgcaaaatcaacattttcttccttttgaagtcagccataaatttttaaaaattcaaggaagtatcattatcacttttaaagccgatcagataataattgaaaaaagaattaatgcaaataggaaaatcaaaactgccatcaaaaccaaaattattcttgcaaatcaagtaataaaaaatctagaaccagatcaagttttaacaaattttcaatcttatcaggttaattatttttcttcctatcaaaactgaattcttcaaaataaaaatgaattaattgatctacttgaaatccaagatactagaaaagctcaaaaaaattgaaaaactactaataataatataaattatcatactatcaaaataaaaattggactaaaaaatgataaaatataattttgccactatcgacatcggcggaacaaatacacgttttgcaatttttagtgataataaaatcacaaaaaaaattaaatttgccactgatgttataaattataaaaaaattcttgataaaattcttgatctagttagccaatacaagattaacgcaatcgccttgtgcatccctggtccggctgattatcaaaaagggattattctctcttcgcctaatttaataggctgaaatggaataaatattaaggaatatctcctaaataattctaaattagaatatgctatctttgaaaatgatgcaaatgcaatggcatttgccaatcatattttttataaaaataccaaaaaaggcgtaactcagttttatacaatctcaactggttttggtgctggactcgtaattaataataaaatttttcatggtgctaatggttttggacaggaaattgcacatattccaacctcaaaaatatttaataaaaagcatcatctaaataattatgcagctgaattatttatctcgggaacaggaatgtctttaagagctaaagataaaaacttagaacaaaccgaaccaaaaaatattatcgcactatctcaagaagataaaggctacagacaaattgttggcgactgtattgataccttggcgcgaacaatttcgataacaattggaattttaaatcctaatttgatggtttttggcggttctatagctgagtataatttttgaataattcaaaaagcgatcaaaaaagcgaaacagtgaacaaataaagaccaatgagaagctataaagtttgaaaaagatccttttggtgatgattcggctttatttgggctttactacctaatattagaaaaaacaaagaaataaagctaaaaataggaaaaaattaggaaaaatcagctatttttatcttttttagaatttttttgcatttttgcctaatttaggtagaatcaatttttgttttcaaaatttgattagctatgattttgccgtatttactattaagacaaaaacatttgtatcagaatgcttttttgttcaaattataccttagttatttaatttataagatttttttgtttactgtttacttcaaaaaaatcttataaattaagacctagttcattaaaaacatcctctcatttggggttattttcattcgtaacacaaagaaataagttatttttataacgctcatttttttcaaaattttcaattttttcaaaatcaataagcccaaatgttaaaaatttataatattcaattaaataaggtcgaaaaattcctgagtttcccagtttgatggcaaaaattcactttttagtgaatatgaatatgcagaaatccccgtaaatcggtgttttttacccgtaaaaccttaatttttattaattacaattaattacaattttaaagtaattttatggtataattataaattatgaaaaagcataatttgattttgtttaatgtttgaggatcttcaaaagataaaatatataaatatgttggctgaacacaaggttatgggaaagctccaaaacgttgatttagtataggaaatgtgcaaactttggaaaaaattaatccaaatgctattcaaattatcaaagaaaaattgaaattgttttcaaatttagatgacaaagataaaatcaagactactttacttgattctattaaaaattccgccataatcgaaggttcggtttttattggtggggaattaattgaaaaacttattgaaaagcacaatatttttgaatcacttcctaaaagtagacataaaaatatgaaacaaatttttaactacttaatttcaaagcgaattactgatcctggtagcattattaatgcttttgataaaaaggatgattactcaaatcaaataaatacttccaaaaatagcttttatagactcttagatcttgtctatgaatcacaaaatcaacttttagatagtcttaacaaaatggttataagcgagcttggaaaaagggacaatgaattttattttgatgcatcaacagtctattttgagacatttgaaggaaatggattaagaattcctggctattctaaagatgctaaattcaaagaagatcaaattgtcattgctttagcatgcgataaaaatggcattccttttcatattaaagtttttaaaggaaatacagccgattctagtacgctaatcccttttgtattagatattgaatccaaatataatatcaaaaatatgacaataattgctgaccgtggcatgtccactgctgcaaatattcgatttcttgaatcaaaagaatataatttcattatttcttatcgtgcaaagataggcagtcaaaaatttaaaaattatttattagatcctagcgattatgttgatgtaaatgcagattttaagtataaaaaagaagaattttattcatcttataaaaataaaagatacactgaaaatattagaagaagaattattacttacagtaaaaaaagagcaataaaagacagcaaggctcgcgaagagcaaatccaaagttttattaaaaaacaaaataaagatggttttattgaagtaaacaaattgtttggtaaaaaacctaaatattttagggaaatttcaaacatgaaatttgaattagatcaaagtaaaattgacaaggacaaacaatttgatggttactatgtctatgaaacaaatatactaaatttaaatgtcttagacatagttgaaaaataccaaaaacagtgaaatattgaagctaattttagaagtctaaaaggtttattgaatattcgtcctgtatttttaagaatagatgagcatatcctagctcatacatttttgtgctttatctcattagttattttaaaaactataatttttaaaatcaacaaacatattagtgataacaagttatttgcaaacagtcaattaactgaagttggtttagtaacgatgttgcaaaaattaagacaaagggttgaatttaacactttagatcaacaaatgatatttaaaaatcgcgatggtgttcctagtgatcccaatatttgaaataggtatgatttctactttgatatcttaataaatcagtaaaaaaataggtaattaacttttggcaaaaaacttaaaaaagcacgggaaaccggacacttttttaaaattatctcatcaaactgggaaactcgggaataagcccaaatgttaaaaatttataatattcaattaaataaggtcgaaaaatttttgaattaataaaatacaaaacaaaacaaagaaaaaccacaaaaaaaacacttaaaattgaaaaaacaatatttgagtatgacaaagttggccccatttttactttggaaaccatcttaacagacttgaaactatagaaaatgatagtttctagtacactttgcaaaagaaaaacagaaaaaagggagaaaataattgttaaaataattcaagataatactgaaaaaataaacaaatttaagggtttcttctttattttttgaaaataattaactttgtaatcttgtaaaatgagataaccttcatataaattaacatctttaattgaacattttctcgttggaatatgacttgaaattttctttttttgttttgaagtaaaaataaatagaccattataaaatgattcaaattttgaaattgtcaaattatcattatattcaaaattatcaaaatcttttaataaattattagtttttaaaaattctttctttattgaatctatttcaaaatggagtgacaaaccttctaataatttattattttctttaagaaattttctgcttttaaataaaaaaaatagagctaaacaaagaaaaatgatggttaaaatacttaaaataataagaaaaatattcataattttgattcaccgagcaagattatcaaatgattttccatttttaattacaaaagatttaaaatcaaattttataaaaagggtcagtgataaaaacaaaaaaaataaaattgaaaaaattgaagaaattaaaatatcatttttattttgttttattttaaaaataaaaaaagctacatatttttttattgaatcatttttggtcataattttccaaatttcatttaaatataattatcttcttattgattattgataatagcagcaatctcatctaaaagttgaaatttgacttgaacttcctcatttattttttcaattatttttaaaaaagaaggtttttcaagaataatttcaaaattataaaatggtttattttgattttgaaaaactaatttttcaagtttttcttctaaaaatttaaatttattttgctctaaaagtttcttatttttattattaataaatttagattcaacaactaaaaaatttccgtttgtaatacggtcaaaattcgaaaatatttgtgaaaaatctagataaaaaactaaattttttgatgttgttattctaaaattaaaatcaatctcaccttcacctgcaaaaattaaatatttttttgctaataatgataattgtggaagagttaatttatttactattaccggctttttagtaatatcagggattagttcaactttttgaatatttttaaatgtaaattcaatttctgaaataaatttttccatcgccactttaccaaatttcatctcaaatctacgttttgggtttaatcaagtaattataaaactaggtaatgcgaaaatagtggttataatccaacatgaaatagcggtgtaaataagttgccaaattgcaaataaacggttttcattggtggttcaatcagaggaatatgttctaagagatgataattgcaaaattattacaattatggtaaaaatagccgctaatggaagaaaaatagaccaaaaaagctttaaaataaagtatattctatttaattttttagttaaaaatttccctcaataccacttaaccttcttctcgtgtaaaccatatttgcgtaaaatttcctcaactattttcctatttttctctgatttcataattttgtcctaatttgaagaaaattaaaaataattataaatttttggaaaattctttactaaatattgacttttcatcaagactagcaaaattcttatcaaattccttaaaaaatggctcattaatagacataattctagtaggtgtcataaaatcaatttggggtataactacattagattttggatttttttccttaaaaatatccatatttctaacttgatagacagggactaaaacccctgtaagttgggataaatcacctaaattaaatagcattttcctcataaatcacctttggaatttataatagctgctaattcatctaattgataaaatttcttttcaatttcaagttttatattttgaattatacatcaaaaagaaggcttttcaataaaaaattcaaaaatattaagaggtcaattagggtttaaaaaatgaaattcttcgcaatcatcgtttaaaaatttgaacttttggttttctaaaagtgacttaattttactattgataaattttgagccaataattaaaaaatttttatccccgtcaagcttataatcatagaatatccgaaaatattttgaataaaaaactaaatttttttgttgctattttaaaatgtgaattaacaatacttttattatcaaaaataaaattctaatctgtaagtataatgctcttaacctttgaaattgaagttagttttaatttttcgattaattcaccctgttcattatcaacaactacttcaacttttttaacatttttaaagttaaaattcatttctgaaactattttttttatcgatcaggaatcaaaattaagactaaattttctgcctggatttaatttagaaaaaataaaacaacctaatcataaaataatgccgataataaaacaagaaatagcagaatataaaaattgccagattagaaagtttttatagtcaatttttagttttacagagtccttatgtaaatataataagggaaataataagaaaaataaaagctaagagcacaaaaaatccaaccagattttaaaattgaatataaataattcaatttttgagttaaaaatttttgttgccttttccgaaaaaaccttttatttattgaatattttagtaaaatatcttcaattatcataatatttttatctttgggcatatacaaaaaaccatcaactctataatttaaattttagtatattttttatattagattaaatctaattttcttaataatacagataaaatatacaagtttagcttttttttaggagtttttaacaaatttatgttgataaattaaaaaaaattactatctttggttattaaaaagatgtgcttttaactttgactaataaagtcccggttttttaaaattttttagtcgcctaaatttagttgaaattaaaaaatcttggaataataaattgatatatttttttgatataaattaatataaaattcttgcattttagaaattaattttaaaaattttcttaccaagccgaatatattcatcaatttgggtttcaagaagtgaaaatgcttctgtataaattaaagaatccccaaggtcaatcccggctttttccagaattttacttggtcaatcagagccaccttttgaaaggaagttttcaatgtaattgtcaagggcttttttaccttcttttttatatttttgaaagaaagcattagcaacaagatagccaattgcatatttataaacataatatccataataataatgtgggacaattacactataaacaagcggtttttcatcatcaagtgggtcatttggattatatttttgtagaatttgcttataaattcccacaaaagcttcataagaactaattggttcacccttgtcaattttattatataaaactgcttcataatccgctcaaattacctgacgttggacagtcgcaataaaatttgaaatttgttgagataatatttcaaatttgaaattttcatcaccttgtttttccaaaaggtagtcatcgagcattaactcattaaaaattgaggcaatttctgcaaggaaaattggatatgagctattatgataattctggtttttatcagaataataagaatggagcgaatgacctaattcatgtgctaaagtatgaactgcgtttatagtaaagtcataattcattaaaatatattttttttcaagcccatatgaacccccaattgaataagcaccagatctttttgaatcaacataatgatagtcaattcatctttggctaaatgctttttctacaacatctttatattcttgacctaatggtttgattgccccaagcactattttttgtgcatcttcaacagaataattattttttgtctcaactaatggaactaaacggtctcaactattcatcttagtcccaaattttgcttgataaaatttttcttttgcttttttgaatttttcaaaaataggcgctgaattagcgacaaattgaaataatttttctaaacttgtaactggaaaacgatcagaactaagacttgcctctagcagtgattgataatttcgcattcttgcatccacagaacttgacttaatatgctgatacaacaaatttgcaaaggtgtttttatgttcaagataagctttatgatagtttatatatgcattttttcgcactaaaggagaccctgtttttaaataattataatagtttgttgaattaagaggtaatttcttattttcttcgtttagaacatcctgaaattttgtttctgaatttgaaagaattgagaaaattttataaaccgaaatttcaccaaaagatgattttgtaagataactttcaacctcatcagcaagtttatgttttttattatcaagtcgataatttagctctttttgataaggttttactcttaaatcgttgattcaagaacgaattttatcctcatttttataaaaaataacatcaattgagcctaattttgactcaaattcagacatcaagaaactaaaacgttcattaatttgactaaaaacaggatcaattacattgacgctgatattgtttgaaatataattaagaattttattgtattttatcccaaaattagcttctagttccttatattcaagaaaattttcaacattttcaaattgttgatctttttttgatattaaatcattagaaatttcttgaatactagaaaaattttcctcaatagtcttaccttcaagtagcacatctaaatcaaaacggtatttctcaggaatttcagaatattttttatattgcattttatttaccttctcaaaaatagaaaataattttttagtatttatggtataattttttctcggtaaaataaaacgattaaaattctttaaacattttaaaatcgagtataattattttaaatttttattacctaaatatctaatccaataaattatagcataaaaggtataaaaaacaaaataaatcattataaaaataataaaataatcaatagaaaaaagagaaaaatgcaaaaacctgatttttctaaagcttttaaaatctttttatcatattcttcttgcttaacttcaagtctagctcttttatcctgttattcttccttaacttcaaatcgagatagcagaacaccaaatcaaaatgaaaacgagttaactgacaaaaaaaacacaaatacttccaatagatttaaaaataacgtaattttgagcgaaattaaatatttaacacttggcgattcaatttctgcagggttcaactgggactatagttttgattttcggggtaatattaacaaaaatttgaaaattaaaggactttcatatgcagcattttttgccgattttattcaaaaaattaaaccaaatgcaataaaatcctttgataatcttgctctttcttgaacaacaattaaggactggctttatcttttagattctgaaaatgaaaaatttcaaaattttgacaagatacgtttaaattttaattacgaacttgataaattaacaaaatcaccttatggaaagcaaattcgtgatgtttttggtaatttttctgctaaaaattacccaaaattaaaagaaaaaattaaaaacgctaatcttttaacagtctctcttggcgcaaatgatttaatggaatcaattgattttaaaacaattgcaaaacccaaccaaaaaattgccactaaagccgaagctgctgctgaatttgttgcaaaaattaatttagctattgttaaattagaaaaaaatttaaatatatttattgaaaaaatccgaaaaattaaccctaatttagaaatagttttagttggttataacattttgttttcatcttcaatgaaattttttgataaattattgacaaacgagctcggtcttcctaataattacacaattattgcacttaagcagttaaatgaagcggttaaaaaagtagctcaaaaacatgggattaattttgttgacctttataatgaaagaagttggttagacaaaacaaacaaattcgcaaaaaatgaatttgacattcacccttcaactaaaggttataaaaaaatggcacaggatttattatttaaacttgccttagagcagggtcctaattttaaaactgattattttgaaaaactagactgaaatcaagaatatttcgaaagggattctaactgttataagcgagttttaaatcttgggccaaattcagaaatttttaagactctaagcatcgataattcagtcaataagtttattactaataaatctgaaattgaagaaattagtagtgctgaaattgaaaaggttaagaattcacaacttgcaattctttcaagaatttgatatgaggtgagttttggaacttttattgatggttttttacggtcaaatactcaaattagtgaaaaattacgggaaatgttgattaatttttggcaacaaaatgcaaaaaataatccttctttctccaaacttttacatcaatttttacagagcgatttttgacttgagatcatcggtcgatttcaaaattacataaatgacgtaataattaatcaaaatttagaaaaagccacaatttcaggactaactaatttcctttttaccgactttagtgagaaaaaactaattagcgtttttaaggatgcagttaattctgattttgccagtcaaaatattaataaaattaaggaactaatttttatttgtgtttttggacaaagtgcaattcaggaattattaattaacagtattatcggaatttcagctgaatataaaagtgatttacaggtaatttttagttttgaatcaacccgaaatttatttacaaaaattattaatgattttgttttagaatcggcaaaatatgaaaatgttaataattttttagatattcttaaaattttcctagataaaccaaaaaattacgaaaatattgtaaaattctcacgaaattttatctctgaaagtttaaaacaccgcaaaactgtaaactttttagtacaaattattaactcaaactttaatttgaacctatctgaagatgataaaaatgcattaattagtcttttactttcagtttctgatacaattattcgcacaaaaacttgagaaaagctaaacaatgaaggtgctaaaagttttttaaatattgttaaaaatactgattttagacatactagtaagaaaatttccacaattttaggtagtcaggttcaaggcacttatgcacttttttttaaaaatactacaaatttaataaatttattgcatgaacttttatcatttgatttgagcaactatcaaattgaagtactaaaaagattactaacaaaactatatccattaatttcaaaatttaaattaagttattttatttcgacagattcaccaaattataataatttttctgtttttttcaactctgttaagggttttttaattgaaaattcttttcaaatattcaacaaaattattagtgaagcaattaatgattttgttgttaataaacttttatatcaaaaaattggaaatttaaatcgttttggatttgaattcctaagaaataatttagaaaaatttgaagaaaatatttttgattttttagcaaaatgtgtaaataatattgatttttttacgaatttgtcggacttaattaacaaatcgcttcaatctgaagggctttcacaaaaatcagtgctaactttctccaaaatcatcaaaactatttttgatgattttggagaaaaatataaaaataaacaattgaataaaaatgaacaagatgaaaatttgatttttattttggtaaaggaagcaataaaaagttttaaaaattttaccaacgataattttaataaatataatgagctaaaagtaaatttagaaaaagcagaagatgaaaaaaataattctaaaatcaatttttataagacaaaaattgatgaacttgaaaataatttgtcaataataaatttctcaaattttttcctaaaaaacttaattgaaactgatataaaatataaaattttaaaaaatatcgcaaaaattaatttaaaaaataaaattggtagtcaggatttaattttattttttaaagatctctttagtaaatcatttttacacaaacaaattgtttctaacctggagaataatagaattttcggaaaagaaggggttaaaaattctcttttagaacttttagttaactttttcaactcaaatcaggtagaaaaactacttgaaaaatttgttgattacttttttgaatctaaaaaattcgaaaaaacaacagattttacaggttttgttactaattttataaaggaacatgctgaattaattgaaaaaattttcggcctttttcttggagatactgcaacctgaaactcactctcaaattttttaatgtcgatttttcaagcttctaagattaatttatctgaaaaagcaactaccacaattttgactttagtacgtaatatttttacaaaatgaaaaaattcaaccttaaattttgaaaataaccaaaaaaaagaatcgcccttagttattcaagcattaattaaaattatttttgatagtttttctgataaacatactcttaccaaatcaatttttgaaagcataattgatagtttaagtgttgatattgcaaataattattataaaaagaatgaaaatagttgatcaacatcagatcaaattagccaaaatgaaattgcaaacttatttgctgaaattgcacaaaccgaagcaatttccgaaaaaataaagtcaaattttataaatattcatttagaatatagggaaaaaatacagcaaatttttgatgcatttttaaaatctaatgcacttgttgagttatttgacggatattttaaaataattgcaaaagccgaaattaatgagccgctaaataatttttcattggttaaatcattatttgaaaaccaatattttaccaaaattattggtaaatttattataaaattggaaaataacgttaatttaaaacaaaattttaccttattattaagcaaaatttttaacgttaattttgaagagaacgaatttgaaccactttttaaactaataaaatacataatccaagataatattaacaattactatagcaatgaagaagatcctaaaaattttctctataaaaaattgactaataattcaaatttatccagtgaaaatactagccaaaataatgaaaatttaggcacagaaaatagcgaaaatactataaaatacggtatttattttaaaaaaaatgccctactaaccaaactagtatctcttatctctaaacttgcaaacacaaatctatctactgctaatatcaattttattttagaaaatgaaatcggaaatgaagaatttattatcgaatttctaaaacaaattggttgtgtatttgataaaatcaccaaaacagatcaagaaaaaatttgggaaattctagtaaaaatttttaaatctaatttccttaagaaaggaattgaatttttcaaattttctaattttaataaatacaaattgtttgaagaattaagcatacagaaaaaagaacaaattaattcagcccttagaagtgctatggagaactttcttcctaatccagtaaacaaacttttaatttttagaatttttaattttattaaccaaaatcccgataaattcaaagaaattagaaaattttcagggttattaactgaatttctaaaagataatcaaacaagttctaatatgcaagagaatcaaaagcttactgaaaaaattgacaattcagcatttttaaagtcatatttatgatatttaataaattttttagtcaaaaacgaggaatttagtcagcttattgttagtcaaattcttgaatatttacatttagatattaaagatgaaaaaaattcttacctaaaaacaaaaggaatttctaatccagaagaaataataaaaaattttttaaaccattttataaatctgggatttgaaaataaaataattgaaaaaattcttgaccaaataattaatagtgttaaatctgcccatttagaagcaaaaagtaattttttcgataatattttaacaaatttaaaattatcagaagtactaaatttagatttacttgttaatttagaagaaaaaattactgatgaaaaaacactaaacaataagttgcctcaactagaaccaaaaattgatgagcataatttaataataaatttgccgcaaaatcagcaaattcctattgattcatttgttgattttttagaccttatttttctagcatcaccaaaatgaaataaggaaaagcaagctgaagtctccccacttctaaaagaactaaacaatataacatatactggaatttcatttgccgatttgttaaaatctaaccaaagggatctaaaacttgaagcgatttcaaagttattttcaaaaatttatagtgaaaacatcactaaggaaaactataaaaatagtgctagaggtcgaaatttatatagatttttattaatgttacttttttatgcttatgaatcacgcataaaaaatagtccattgaggacaagtgccttttatgggtctattcttagttcatccactgcttcggaaatgatcctaaattcgctaaaaaatgcaggaaaaaatgaaaaaaatagtcaaaaatatagtgaatttatcgattttttaaaaggaaatccaattaaagttaagggttgattaataaatacatggtataccgcaaaagatgtacggcttgatgatatgttaactttaatttattataataatgaggataatcggtttaaaaacgaaactgggcaggaaaaacttaaagaccaaattcttgaacaaatcagacaaggtcatttccctgacaattttgaaaatccaaaaataatttctaaataagaaaaattatacactaaaaaaatttatttcaaaaataaaaaacttcagtttattctgaagtttttttatgaatattttaaattatttttaaatattaaaaattatttaataatttcggtaactgttccggcacccacggttctaccaccttctcggatcgagaatttggttccctgctcaacggcaattggggcaattaattcaacggtaagatcaacattatcccccggaattaccatctcgcgacctggttcaaactcgattccgcctgttacatcggtagttcgaaaataaaattgtggtttataatttttgaaaaatggtgtatgccttccaccttcttcttttttaagggcataaattgcagctttaaattttgtatgcggtataattgtttttggttttgcaatcacctgaccacgttcgatatcttttcgatctactccacgtaggagaacaccggcattatccccagccatcgcagtttgaagatttttattaaacatttcaattccggtgattacggtctttttaggttcttcgcgataacccacaatttccacttcttcgtttagtttaacttgacctctttcaacttttcccgttgctacggttccacgtcctgtaattgtaaaaacatcctcaacggccatcaaaaagggtttatccatttcccgaacaggtgagtcaatataagaatcaactgcgtccatcaattcaagtacttttgcctcccattcaggttttccttcaagggccccacgagcagatccccgaataattggagtattatcgccatcaaaatcataagaagaaagaagttcgcgaatttcgacctcaactaaatcaaccatttcttcttcgccttcaagtaagtcaattttattaaggaaaacaaccatttttgggacaccaacttgttttgataataaaatgtgttcacgagtttgaggcattgggccatcggttgctgcaaccactaaaattgctccatccatttgggccgctccggtgatcatattttttatataatcggcatgacctgggcaatcaacatgggcatagtgccgtttgtcagtgctatattcaatatgggcggtattaattgtaattcctcgtgctttttcttcaggagctgcatcaattgaggcataatcctttgcctccgcgagtcctctttttgccaaaacagttgaaattgctgctgttagtgttgtttttccatggtcaacatgaccaattgttccaatattaatatgttctttggaacgatcaaagtctttttttcctgtcgttttaacaactgccatattttttcctttcgcttatcatttattatatcgtaattatattatattatattattgttttaataaaaccttgcaaaaaaccaccgctgaatagccttgcaactatttcctatcctttttttgcaggtcggattaaaaaaaaataaacattttcaaaaataatttttaaaatgattctttttataattataccaaaatttgaaaaattattttaagaatttttttaataaaaaaataatttagaaattttacttaaaaaccgcagtttttaaactgattttattttttaatagttttcctatttaaaaataaaatcataaatttgttgataagtatcaacgggaataaactggattacgtcttttacctcctgcggaatatcgactaaatttttctcgttcgcctttggaataaaaataattttaatcccatttttataggcccccatcgtcttttcttttagtccgccgattgctaaaaccttcccgcgcaaggttatctcccctgtcattgcaatattatgtgagaccggcttttgcgagagggctgaaattattgctgttgcaaaagttatccctgctgatggcccatcttttggaattgctccttcgggtacatgaatatgaattaaagtgttttcaaaatcaaaattaatcccaaaatccttggcctttgactgaacataagaaagggcaatccgggctgattcttgcattacatccttaagcgaacctgttagtttaatatcgcctcgtccgggaatcgtgcttacctcgatctgtagagttgatccgccaagtggtgaatatccaagtccagttaccgttccaatttggggacttgaatcgacattatctggatcatatttttcaatgcctaaaagttcacgaacaaattcaatatcaattacaaaattttgatctaatgttttctcaagtaattttacaataatttttcttacaattttatcaattactcgcttaagacccctaacaccggcttcgcgtgtatagtggcgaatcaaaaagtcaattgtttgatcctggattggaaaatattttggatctagagcattttcttttaaaactgccggaattaagtgggattttgcaatctggattttttcaataaaagtatatgaagataattcgataatctcaacccgatcaagtaaaggctcaggaatatcataaatttcattggcagtagcaacaaataaaacttgggaaagatcatattctaattcaagataatgatcctggaaaaaacggttttgttcaggatctaaaacttcaagcatcgccgcagatggatcccctttaaaatcagctcccattttatcaatttcatcaagtaaaattaagggattggaaactccaactttttttagggcttgaataatttttcccggaagagcgcctacataagtacggcgatgtcctctgatttcagcttcatcacgaattccgccaagggaaattttgacaaattctttaccaattgcttcggccaccgccattgcaattgaagttttcccagttcctggtggacctactaaagtaagaattggaattgaattacttcgtactttacggattttatgacttaaaaataaatttgaatcaatataatctgaaccaactttttccaattcgggtttgccttcagattgcgagcgcctatgaattaaggcagcaagatattcaataatccgcttcttgatttcatcaagtccataatgggcttcttcaagtttttctctgacatttttaatatcaagaatatctttttttaccttttttcaagggagagcgactaaaagatcaagataacttttggtgatatttgactcgggcgaggttactatcattgactttagtttgtttgtctctcgcataattgtttttgcaacctctttagggaagacttttttccctagttcggaatgaagaagttcttcgatctcatcttcataacgggaatcctccccgagtttttttctaattgctttaattttctcttttagaataaattcagtttgttgtttgtctaaatttgtttttagaataacattaatttcatcttctagtttaatttgctcagcaaatgtatgaatatgttcgtataattttttaatttttgctggataagagttataagaaaaaagttggtatttctggggataagtcagacttggcgagcatgataaggtatttgttacaccttttatatattcgtttgtactatattcagaattagcaccaaatttatcaacaattaaaagtaattcagttggaattctaaaattttttgcttttcgggccatctctaataaatcattgatcaaatttatatgaatttcgggactttttatggtttcgcggacaggttttattataatttggccaacttttggattttgaggatcgttgattagctcgactaattggactttttcggttacaataaaatctaaaattactgtttgtcattcacttttatctggacttgtttttgcccgataactctgaattcttgccaaagaagcatattttgaaagctcatcaaggtcataaatgcgcggtaaaaggctattttcaaaatcaccaacttttccattaagaatttttgcctgattttgaatatcattttttgaatcttcaaaactattaaaatcatttcttggaaattttataacactagaattcttttttttagtatctttttccttctctttacgataaacaattaaaaaatccttatttgttagtgttggtcttgaatttgaatgataaaaatctttgagaactttaatcgattccggatcgctgaaagtaatagattgctgtagggtattttgaaaataaatgtcctcagaagcgactaaaaaacgataggaattagttggcatatttaaaaaatctccatttttgttttatattttatttaatacttgatgacaaaagttgcttaaatgcgataattataccataaaaaatcaacaaatttaattgctaaaaaacaaaaaagaaatttattaggaaaattaagttacttttttgttctagttaaaatttttatttaattttttactctttttgataagaaataatcagcaattatatagattggcaaagccaaaaatgattccagggaataatttgctaaattaaaaggggcaaaagcgcttaaaataaaagttcaataagaaagtttcagccctccaaatttttccctaatctcagaccaatgctcaatcatttttaataaagaaattgattcagtaagtttatataatttaaaatacaccggtgtaattaaaacgccatttaaataagtcattaaaaatgttgtaaccaaaacagcaaaaattagtgctaaaataataaaagttttagttttttttgagtttataaaaatcttttttaataaaaagcgaaaagataaaaaactaaaaatataaatagaagaagctaaaaataaaataaaatgaccaaaataaacaatatcaattccgccaaaagtattaaaaattagtcaaggtccaattgaaaaacgaattaaaaggcagataattccaatcccaaaccccgaaattaaaaaaattgggataaaaaaaagggttgaaagatcgactttaagacctagattttgaaagaagggccagctgaaataattatgcgaaaaaattaaaaaaataatcgaaagtgaaagtaaaattccggctactgttaatttaaaatttaaattagaacgccaaaaaattgaattagccatatttagtcactaaaaaaacgatcccctgcatcgccaattcctggaattatatatcctttattgtttaattttggatctttttgacagaaaaatattgaaatttgcggatatcgttctaatattttatcaattcctacctgaactgttaacatcgttgcaatcactatttttttatatcctttttcaagaattatttcaattgcacggattaaagtattccctgttgctaaaataggctctaaaacaatcgcaactgaattaggatttgcttgtggcaaactttcaaaataagtctgaattgataaatctgaatttctttttaaaccaattggtgcaactttagcatagggagcaagttcaagaaaggagtcaagcataccaaaaccggcccttaaaatcggaataaaaacgagttttgtaataattttatgacctaaaaattcatgacctaataccgatttagctctaaattcttctgtttctaatctagataaaactggaaaagcaagcaattttgatatttttttaatcgaattgcggaaatcttttaacgttgtcatttgccttattctagcaatttcactatcaattaaaggatgatcaacttttatttccatattaatttctcctttaaaaattgtttttttacaaaacaatttttatttttttaaaatagttgtattataacataaattttaaaaaaaataagttaatattcattttttttatcagtcaaatttttgataatacttactgattttgaggtgccaaaccttgttgccccaagtcggtaaaaattttccatatcggctagatttgtaattccgcctgcggctttgattgccaatttttcgcttttgttttctttgatgatttttaaatcctgttcacttgcacctcgataggaaaatcctgttgaagttttaataaaatcggcattggttgaactaactaattttgtagcatcagcaatttcatgaggtgataaaagggctgtttcaataataactttaagaattttagtgccgatttccttcttaatttgattaatttcgttaatgataaattgaaaatccttctctttaaatttaccaatattcatcaccatatcaatttcatctgccccatgagcgatagcaagtgaggcttctttttgttttattgcactaatttgacttcctaaagggaaaccaattactgttacaattttaatattggtatttttaagctctttttttgctaattttactcaaattggcgcaatacaaattgccccaaaattatattttttagcttcttcaattaaaattttaatatcctgagaagttgcctgtggttttaaaagtgtatgatcaattattacgttaaaattcatataaattacctaatttttcttaaaatttgcccaaaaatactatttttttcttaaaattttcatttttgtaaaagtttttagctaattttatttattaattttagttattataccacgtttttatacaaaatatttatattttggaattttttgctgccacagacataaaaattaaatcaatgataaaactataaaagttgcttttaaaaagttttgataaattttataataaaaactaatttttaatttaaaaaatgtggtataatataaattaaaatcatttgaaattttacacttgtttttaaggtcaaattttgactttttaaaaaaaataattggtaaaaatactttaaattttctatttgaaaattcttattaaaacataaaaaatatggtataatttatacttaccacgcgcttttatatcaaaaaggaagaaaaatgcttgaggagaaagacaaagataagtcaaattttgacaatagcgagttcgatatcgaatcaaatgatgaaatagatgatgaagatactaactataaagtcaaacccacaattttagaatcaataacagataatatttctccaattaaaattgaagatgaaatgaaagcttcatttcttgattattcaatgtctgttattgtttcgcgtgcacttccggatgtccgtgatgggttaaaaccagtccaccgtcggattctatatacaatggctgaactcggaattacttcgggaacaagttataaaaaatccgctagaattgttggtgatgttcttggaaaataccatcctcatggagatgcttctgtctatgaatcgatggtgcgaatggctcaacctttttctttacgttatcctttagttgatggtcatggaaattttggatcaattgatggtgatgaagcagcagcaatgcgttatacagaagctcgactatcaaaaatttcaaataaaatgattgaggggctgaaaaaaaatactgttgattttcggcctaattatgatgcaagcgaagttgaacctgaagttttaccagcaaaattccctaatttgttagtctctggagtctcaggaattgcggtaggaatgatgacaaaaattccgccgcataatttaggtgaaattattcattcctttataatttttgccaaaaatccaaaaattgaaattaacgagttaatttcaagtctaccggggccagattttcccactggcgcaacaatttatggtaaaaaaggaataaatcaggcttatctaaccggaaaaggttcttttataataagggcaaaagcaaaaattgagaaccttaattccggcagatcgcggattattttctatgaaattccttatgaggtaaaaaaaccagcaattattgaaaaagttgcatttttagttagaaataaaaaaattttaggaataaaggatgtccgtgatgaaagtagtagacacggaattcgcgttgtttttgagattaaaaaaggttttagtcccgaaattatcctaaataaactttatcatagtaccgatttgcaaattaattactctataaatatgctagcacttgttaatggtgtgccaaaattgatgaatttggcacaaattttcaactattatcttgagcatcaaaaggaaataaatctacgttcgcttaattttgacctcgaaaaagcaacagaaaaattgaatgtcttagaggggattaaagttgcagttgaaaatattgatgaagtaattaaaattataaaatcatcaaaatctgatcaagcagcccaggaaaaattagcgcatacatacaatttaaattctgggcagacaaaagcgataattgaaatgcgacttggacggctaacctcacttgcaattgaaaagttaaataatgaaattgaagagttaaaagttgagattagtgaaattaaatcaattattgactccccaaagaaattaattgatttaattattgagcaacataaaaatgttgttgctcaatttggtgatccaagacgatctgaaattattcctgaaattgattgcttagatgaagaagatttaatagctgatgagcaagtaattatttcgctaacacaaaataattacgtaaaaaaaatggtgttagatgaatatcgtctacagaatcgcgggggaattgggactttagcatcaaatcattataaggatgatgaactaaaatcattatgcattacaaatactctcagtgatcttttaataatttcctcaagtgctaaaatttttaaattaagggcgcaccaaattcctgatggctcaaaacaaggcaaaggaattccgattctaaatttaattaaattagaaaaaaatgagagtatttctaacttaattccttgaaatcaagaatatgataatcactggctaattacagtttctgctttcggaaatattaaaaaaacagcccttagtgcgtttcgaaacattacaaaaaacggaaaaatagcactaaaactagtcgaaaatgactatttagtctcagcttttatagcccctaacaatccggatcttaatattttaatcggctcatcgcaaggttttgttaatcgctggtcgataaaattattacgagatagtggtagaactgcaattggagttaaaggaatcaaactcgaagaaggacataaaataattggagcttgttttgctttcgataaccattttatttttagccttagcaaaaaagggtttgggaaaaaaactcaagtaggtgagtatcgccttacagggagaacgacaaaaggacttatgagtctggatgcaaaaaaagctggaaatctggtgtttatttccgcaataaaaaataatgaagaagcaataattacaacaaaaaaagggtttgcaattagaattgatcttgatatggtgccaataataagtagaaaaactaagggtgtaaaaataattactctcaaaaagggagatgaaattaccgcagttagtttgatcagtaaaaatgaaactgaaaaacagaatgaataaataaattataccacaacttttttgtattttaaaaaaattattttatatctttatttaaagaactctaaaagatgacctaaattatgtgattttagttcagatttaggaataaatttaagcgatgctgaattaatacagtagcgcctccccccgaattgttttggaccatcgctaaaaacatgacctaaatgcgaatcagcgttttttgaacgcacttcgattcgagttagcgaggcactaaaatccagaacctccactattaaattttcatcaattggttttgaaaaagatggccaacctgaacctgagtcatatttatatattgataaaaaaagtggagttccatctacaatatcaacataaactccttcttgataattattattataaagattatcaaaggcaggctcagtaaaattttgctgagttaccttgtattgcaattctgttaaatggtctaattttttttcttttttcatagtatttctttttgtaaaaaataaattatgctataaatttaagggttttttaaaaaatttaagatcaaaaaaattttagtaatatactatttgctgatcagggtttatcatatcatttttatggcgtgaacacaaggataaaaacataaacgtagcaattatatcaagccaagcgataaaaattcctacaattgcaattgtttttattgttgaaagttttgataataaaagttggttatttcgaatttcaagatcatcggcaagactgtttaatttaaaagcaaaaatcactagaactattcggtcggcgattgttaataaaattcagataataagcatcgttacaaatacgcctaatcaagacccaagatcctgttttaaatccttaaaagaaatatccacaaataaaattgggccaataaaccagacaagcaaaaaaatacctaataaaaattttaaccgaagtattaaatgagcaattcctaatcttcgaacaaataataattttctttttctttcttctaagtcaaaattcataatttaaaaattataacatttattttaagaatttaaattatttttttagaaaaataaaattatctatcccatcctaaattttttgccaactcgtttttataactttcaactcccggttggtcaaaaggatttaccccgagcaaataagccgacattgcacaagctttttcaaaaaacatcacaagatgtccgaaagttttaggcgaactatctgcaatttcaagcactaaatttggattatttccataggaagaatgcgctaatgtggttgctagaaatgcttgaaaatttatttctgatactgtctttcctgaaagtttattgatttttgtattaaattgcactatttttttaattccaaggtcaaattttggcttcttaatataaataatagtttgaaaaaaatttttactaccatcttgaataaactgacctagcgagtgtaaatctgttgtaaaaattgctgatgccgggaaaagacctttaagatttttaccttcagattcgccaaaaagctgttttcatcattcattaaaatagattagaaaaggttcatatgaaatcaaaatttcagttttataattaaaatttttatacatcaaaaatcgaaaaagcgcgtatttgtaagctaaattttgagaaattgagcttgttgaatatcttttatgtgcttctattgcgccctgaataatttcatcaacattaatttttgcaaaaagtaaggggaaaaatccaactgatgataaaacgctaaaccgaccaccaatggattcaatgacttcaaaaatttctaattcgttagactttgcaatctctaaaagttcacctgattttatacttgttgttacaaaagttcttgtttttgcgagcttttcaccaatttgatctattaaaaattgatataaaatttgaaaagtgatggctggttcaattgttgaaccagatttagaaattacattaattgcaaaattttttgtttttaaatattctattttttggtataaatcagttgatgaaagcgaattgcctaaaaaaataacctcgggtttgttttcaaaagggcctaaacctaaaataaaatcaagagccgcttttgcacccaaatatgagccaccaattccaatgactaccaaaacgtttatggaattttgatgtaaattttccactatttttctcattcttgcaatttcttgagggttaatagctacttctgggaaattatttcaacctaaaaaattaatatcaggactatttttgtcattgattcggttgtgaaattcattaatttggttctgaaaaccttgataatctagtttaatttctgtttttacttctaattttaagctcattttttttccttttttagaaatttaggaatttttttatgtatgatgaaggttttttgaacttaataactaccatttgatcataaaaaatcagttttaatattaataattatacacctttttagctatttttgctaatttttagtcaaatatatttacttgcgccctcttggatattttatcaaaaatacctaattccttgagcttttttaatgatgtactatttgtttcggttctcttttcaaaatcctcaattgatgaaaaaggtcttaaattacgagcctgcacaatttttcgagcattaacatcaccaataccatcaattgcaataaatggcggaattagtgaattattttctttgttgattattcattcctgagcttctgatttctcaagacttaccttttcaatttcaaatccacgggatttaagttcaagactaatctctaaaaattggattaaatccttttcttttgcacttagttgctggattcccttttgactttcaagtctttttttattaagaatactaattttttcgcgaattttttctactggttgaattaaagtttcaagatctttaacatcaggccggattgaaaaataagaagaataaaaagcaagcgggtgataaagtttaaaatatgcaatttttcatgccttcattgcataagcaactgcgtgcgccttcgggaataaataaccaattttctggagtgattcaatataccaactaggaactttttttaattctagtaattctttttcctgatctgttagccccttgccttttcggacattttccataatattaaaggcaacttggtggtcaatatttttttgcaaaaggtagatcataatatcatcccgacaagaaattagctcgttaattacgtgctttttttctaaaattagtttttcagcattatcttgtcagaccccagtaccatgtgctagaccacaaattgcaacaatatctgcaaatgattttacttgtgcaatttgcaacatttttcttacaaattgcgtcccgaattccgggataccaattgtgcctgtaacctcaccaagaatttgatcggaactaattcctaattctttacatgatctaaaaagtgaaagaatttttggatcagatttaggaatttcatcggattttatatttgttaacttttctaaatggagcaaaatagttggatcatcatgccctaaaatatcaagttttaagagattatcatgaagggcattatagtcaaaatgcgttgtttttcagtccgatttttcattatttgcaggatagttaatcggggtaaaatcctcaatttcttgattttgcggaattacaataattccgccggcgtgtttgccagatgttcgtttaacaccttgagcttttgttgctaaaaaatcaagaaaagcgctggtaaaataagaaacttcacggttaagatcaaattttggatcaagtctagcgcggtattcccctaattttcgagctaaaccataaacagttttttcagcatttgtaagaattgttcccgcccgaaaagttttattaattccaaataaagttctaacaaaatcatgcatttttaactgagtctggcccgaaaaattaagatcaatatctggaactttttcaacattaaatcctagaaaagtctcaaaaggaatattatgcccatctttttccatttttttataacaatctaagcaatttttatctggtagatcataacctgataaaaattgctgggatttaggaaattccactttgctacattttttacatcaataatgaggtaaaagtgggtttacatcggtaattcctgttagaaaagccacaattgaagaacctactgacccacgtgagtcaactattgcaccttgtgatttagcctcagttacaatatgcttggaaattcaataaaccacgtgaaaaccctggtttattatcggttctagctcggttttaatgcgattttcaattaattttggcaaaaatctgccatatttttcataggcttttttataaacaaattcttttaattttacctcagaattatcaaaactgggtggatataagccggatttaataatttgaatattgttttcaattagatcagcaacaaaattggaatttttaacaacaatttcctcaattagttgctgatcttctagaaattcaaactcttttttcaattcttcagttgaaaaaaagtgtttttctggaaaaatatgactattgcgaaaatcttctcgctctttttcacgatgatcaaaaaggacatgattcacgccgccgacacctttggcataaatataaagttcataaaaaattttttcttttggcagacagtagcgaacatcgccaattgcaacagcgggaatctggagtttttttgctaaatttattaaattttttaacatatcttcaatttgatctttagtaaaaatttctctttttactaaatgtataaaagcacttggaggcggaatttcgataaaatcaaaaatatgagcaaattctgcaacatttttagggccaaaataaagcattgtttgaatcaaaagcgactctgggccacctgaaccaattaataaatctggatctttttgtaagtgatcataaaaaattaatggtcgagaaattagattttctgtattagccagcgaaactagtttgtataattttttaattcctatctgatttttagcaattatggttaattgttttgggaaaactttttctggacgaagctcgaaaattgagttttttatttcagaaagtgaggttagatcattaatattttgactttttagctcagctaaaaagttttttcaaatagttgttaaaatttttgcatcataatcagcacggtgggcaatttcttcatcatattcaatttcatatctttttgctacatttttcaaactatgacttttttcatttggattcaaaaaacggctaacttcaagtgtgtcaataattggattttttaaggatttttttgctttttgtctaaaaaactgttctaaaaaactaaaatcaaaggcagcattatgggcaactaaaactgaatctttgataatttttgtaattttttccagtgcaatttcccaagaaattgccgtttcatcaatcattttctggctaattccggtgatttttgtaattgcaggcgggatttttcctgtaggtttaataaaaaattggtgcttttcaatttcaataccattttgtaatacgactgcaccaaattcaacaatttcattataaaaagctgaaagtccggttgtttcaaggtcgaaaatcacaaattttaacttatcaaaaatatagttttttccgttaaaattaataactttttcaatttttgaacgatatgttgaaaaagtggagccataaattggcttgatgttagttgattttattgcattataaaattcagggaaagcctgaactgagtcaagatcggcgattccaattgctaaataaccatttttgagagcatgttggacatattctttagcacttgaaattccatccattgttgattttcaagtacgcgcagcgatttcgacgcgtttaattttggcagtatcaagcttttcatttggaaaaaaaattgaagaatcaattcttttaatttcatataaatttaagtcaacatttgatttataacgtgatgtaggatcttttattttggctttaatatttactaaatcaccaacttttaagtcataattttgattttttattaaaaatttactaacactaactgcctctgtataatcattattattaaggaaaatttttaaaattagtccacctgttttagtttttattgggctaattttataaatttgagcatcaaattgcacgttcggatttttatgagaacggataaattttaagtctattagttcaaaatcaattattttcttatttctttcggaaaaatttgctaaaaaattatactcaagtgggcgcatcacagtctcaagatctaaattgaatttattttcaattactggcttttcttcaagtataaaatcaagatcaagatgaattagtccaaaatattttataatttttcgcatttttttttcatatttggacataaattcaaaactttttgcatcagaaaaaataattttaaaccgagatgcattagctcttataatttccttatcattaaaaaatcctttatttttcgatattccttgcattatcccgtttagatattctaataattgttgatcagtaaaataattttgttgaatttcaaagtcaaattcaatcttacagttaaatttggattgcctatttgttttttgaactaaatcgataaatgcacataaatcattaaactttggaagtgtagtttttctaaatattgcagaaaatatttgtgtttttaggctttgatcattgacattttctacagtttctgcgcttgttttttcgattattaccacatcatctcagtcatatggatttgatcaatttattaattgggaaaattttctgaattttgtattcatttttaccctctccttgtatttaaaaaacaaaaactaactaactgtaattacaataaatgagaatactaaaaatacaaaagaaatcgaatcaagccggtcaaaaattcctccatgacctttgataattttcgaaaaatcctttatttttaagtatctttttataattgagaaaaaaatatcgccgataattgcagcagaaggcaataacaaaattgtcaaaatttttaataatagatctctaccagttgaaatattaaaatcgaaattaagaattatagatattaccaaaatcaatgaaaaaataaaggaactaataaagccttcaactgattttttcggtgaaaaattaaaatttgtcctaaaaaattttttagcaaaaattgaaccaaaaagataaccaaaagtatcgctagttattggaatcgaaattaaaaaaatgactaaaaaaaagttaaaagtatttaaaattcatagtgatttaaaaaacaaagtcgatataaaaatgatactaaattttagtattccagcaagaaaaaatcctcctgttttttcaattttattatcaaaaaaactaactattaaagtaagtggaaaaataaaaaaaatgtgataatctaaaaattgccatttaattaaaaaaaatgctagatttcagtcaaaatttgcatcttttgaaaaactagtttcaattaaatcttttcttactggtaatacaaataaaaaaatacccaaaaatgctagtaaaaaagtatagattttttttgactgaaaatgattgaaaatctcaaaaagactataaaataaaagacaacctaaaaaaataaaggaaaaaatccgacctcaaaaaataaagtaataaccaataaataaagccgggaaaacaactactaaaactaaaaaagcaactaaaaacctgataaaaaaatcagctggtaattttttaggccaggataggctcattttaaattgtttgaattgcttttacttttttatcaaaaagttgatcaattttttctatttcagaattaatatttttctgaacttgaccaagataatctttttctaaatcctcagagaattcctctttttttatcagtttgttaatatcttgtcggatcagacgcattcttactttgccttcctcgtgaatttttttaagtttatgaattgcttcttggcgtttttggtgagttggttctggaaaaattagtcgaacttgatttgcttctttttgaacttgggcatcaatttttgcagctacaattgcgcttgcaatttcttttacatacttagtttcataaggttttactaaaagttgtaatggaagtggagcagaaattgaagcgatttcgttaattggggttaaaacatcataaaaatttactttaatataagaaattaactgtggatttggagctccaatagttactttctgaaaacttttttcaagataggaaaaaacatcttgagctttttcaatcaagatgtttttataaaaactaaattcaatttcgttcttcattatctaataaacctccgtgtgtttaatttgtcttttgattaatttagaaatgctatttttttctttaatatcaaaaattagtaatttaattttattatcacgagccattgaaaaagctgttgagtccattacctttaaatttttttcaataacttgattataagtaattttatcatatcttagcgcatttggattaatttttggatcagagtcaaaaatgccattgacattatttttgcccactaaaataatatttgcacccatttcggatgcaaaaagtgttgcagcactatcagttgtaaaaaatgggcggccggtcccgccaacaaaaattaaaacattgttatcttctaaatatttcatcgctttttccctgacaaaatactcacaaattcgcgggtctaaactcatcgaggataaaactcgagttttaattcccaaatcgcggaaaactgaatcaagggcaagcccgttcataacagttccaagcatcccgatataatcagcggtgttcctgtttataccattttttgccgcggaagtaccgcgtcaaaaatttccgccgccgataacaattaaaattttatgccctaaattctgtatttctttgagttgagaaccgatttgtcttacaagttcataatcgattgccagagatttttgtttatttgcaagactttcgcctgaaagtttaataagaatagttgagtccatattagccttaaaagtttcttttattatactttatttttgaaaaaaaatgtattaaaaaaaggaaaattttaggaaaaagttgcagattttattttttttgactaaaaaggccaaaaaaaattaaatataagtgagaaacaaggaaaaaggaagttagaaatgaaaaaaatttttaggcttttaggaggtttaggtattgtaatttcaagtccttttttcatttttagtcaaaaaggacagattatttctaatcctatagagcttaattttaattttcaagaattagctaataaattaaatttcgatcgaaaattaaacaggttataccgaaatgtcaaagtcggagttttaattgaagaaaatggcgataaaaataatattgactataataatttacaagcaatttttgaatttttctcgccaagttccgaacttgttatctatcgttttaaaacaaaagaacaatgacttgaaggaattaaacattttgaaactgtcggtattgaaatgcttattcatctatacaaaaaagaaagaacttttttagatgatttattttgaaaaaacggcgaatacatcaaattaggtgattttctggatctttgaagtgcaaaaaccggaattataaacttttttgatggcagcagacccccaggaaatgaagttaatagtcattttagtttttttgctaaaactgatgaccgttttaagacaaataatcaaatgctatcacatacaaaaatttttggcaatggtttaggaattataaaatcaaatcattttgttttgccagaactaaaatataattatcaactaagcccgcattcttcaaatatggaattttattctgcttttttactagcggcgctttttagtcaactttcatcaagttttgatagttatgaaagtctaaaagatcgaaatttaaaaattattactgctctagcattaactgcaaacccttcagagaatagcaatttagcctttaatggcactcatttaaatgaaggttttggatttataaattatactgacgcccattttacaatccaacaacaaaattatttatataataaatatgatggaagtgaatatacaacaagtccttttgaattagtaaagaatcaaaaattttcagcgatagttttttctgataaattcaccgaaagactgatttttggagaatatttgccaggattttcaggcatttttcacaattttcaaaaaaatatcaaattaattactaatgcatctttttacggtcttcctgaatttaaagtaaatgattttgatatttccattgaaattttccgcggtggttggcataaaataattgaggcaaattcaactatcagtccatatgataaaatcagttttaaagcttttgaagatggacaataccgaataaaaatttcaagtcaaaaatttttacctgacaaacaaagcaaatattttattgcctgaagaagatatccttctgattttgtaacaaaaacacactgaaattaaaacattttttactgttttgtattaaaatgttttatattatgaatctttttgttgatacaacaggtaaatttttagtggttgcgatttttgataaaaattttattttaattgattcaaaaattagtgaaataaaaaataaagctgatattctacctgattttttaggtaaaattttgctaaaaaataagttagaaatcacagaatttacaaatttttttatcaatttaggtcctggaagttttacaggttgccgaattggactcacttttttccggacaattgcacaattaaataaaaagaagatatgaacttgttcaacatttaatttattatcttttaaaatacttgaaaataagcaatattttattgactatagtgaaaaatcacaatttagcgcttttgcccaaaacggaaaaataacttctaaaattttcgaaattaagaaaaaaactgaaaaagcaagtcaagtaaattataatttaatttttttaaattttgataaagcaaaaaaattatttaagaaggaggttgatttaataaatatttttcctttatacataaaataaaggaaaaatattaaaaaaactagctaaaaatattttctaatttgctattttcccgagtttcccagtttgatgagataattttaaaaaagtgtccggtttcccgcgcttttttaagttttttgccaaaagttaattacctatttttttactgatttattaagatatcaaagtagaaatcatacctatttcaaatattgggatcgctaggaacaccatcgcgatttttaaatatcatttgttgatctaaagtgttaaattcaaccctttgtcttaatttttgcaacatcgttactaaaccaacttcagttaattgactgtttgcaaataacttgttatcactaatatgtttgttgattttaaaaattatagtttttaaaataactaatgagataaagcacaaaaatgtatgagctaggatatgctcatctattcttaaaaatacaggacgaatattcaataaaccttttagacttctaaaattagcttcaatatttcactgtttttggtatttttcaactatgtctaagacatttaaatttagtatatttgtttcatagacatagtaaccatcaaattgtttgtccttgtcaattttactttgatctaattcaaatttcatatttgaaatttccctaaaatatttaggttttttaccaaacaatttgtttacttcaataaaaccatctttattttgttttttaataaaactttggatttgctcttcgcgagccttgctgtcttttattgctctttttctactgtaagtaataattcttcttctaatattttcagtgtatcttttatttttataagatgaataaaattcttcttttttatacttaaaatctgcatttagatcaacataatcgctaggatctaataaataatttttaaatttttgactgcctatctttgcacgataagaaataatgaaattatattcttttgattcaagaaatcgaatatttgcagcagtggacatgccacggtcagcaattattgtcatatttttgatattatatttaaattcaatatctaatacaaaagggattagggtactagaatcggctgtatttcctttaaaaactttaatatgaaaaggaatgccatttttatcacatgctaaagcaatgacaatttgatcttctttgaatttagcatctttagaatagccaggaattcttaatccatttctttcaaatgtctcaaaatagactgttgatgaatcaaaataaaattcattgtccctttttccaagctcgcttataaccattttgttaagactatctaaaagttgattttgtgattcatagacaagatctaagagtctataaaagctatttttggaagtatttatttgatttgagtaatcatcctttttatcaaaagcattaataatgctaccaggatcagtaattcgctttgaaattaagtagttaaaaatttgtttcatatttttatgtctacttttaggaagtgattcaaaaatattgtgcttttcaataagtttttcaattaattccccaccaataaaaaccgaaccttcgattatgacggaatttttaatagaatcaagtaaagtagtcttgattttatctttgtcatctaaatttgaaaacaatttcaatttttctttgataatttgaatagcatttggattaattttttccaaagtttgcacatttcctatactaaatcaacgttttggagctttcccataaccttgtgttcagccaacatatttatatattttatcttttgaagatcctcaaacattaaacaaaatcaaattatgctttttcataatttataattataccataaaattactttaaaattgtaattaattgtaattaataaaaattaaggttttacgggtaaaaaacaccgatttacggggatttctgcatattcatattcactaaaaagtgaatttttgccatcaaactgggaaactcaggaatattaaaaaaactagctaaaaatattttctaatttgctatttttaggtaaatcaagcaatttcgaatcaacactaattacattatttttaaaagcagattttcgaattattaatggtttggaattagggttaaatttaacttgattaatttgatttgtctcaaaactacctggaaaaatttcggctaaaatcaaattttttgacaaatcaagttcggtgattttattatcaaaaaaggcaccagtttcaattgtttctagttttgttgcctgggaaaaatctactgtttctaaactgttttttgcaaaagcttgttttccaattgatgtaatagaagggggtaaaacgagcgtttttatattgtttccttgaaaagcgaaactcccaatcctccttaatttcattgcttttgaaaaatcaagttcttgaattttttcattttgatctaaatttgcactatcgacataaaaggcataatcatcaatctcaagcaaactttcaggaaaaattacttttttcagagtataaaaattaattttttcgggctcagtttttttatctttttcttgatctgtgttttttttaacgtctatctgcgaatttactttttgataaaaacgggattttaagctaaaaaatgctgatttttcaatcttttcaagtctagatgctgataaatcaagtgtaaaagtctttgtattttcatcaattattacatagggcgagtctttatcatccttgcttgctaaaagagtttcagcctgggaaattgtctcgctacaagataaaaaaacaactaaaggtaaaaaaattgggcttaattttaaaaattttttaaattttaccatagatttaaaaagtataccataaaagctaaaaaatcctaattttttgttcttaaattataataagtccgaatttgcgaagctaattcttcatcaatcggttttaaaaaagtgtaattaactacataccggcgctcattttcgttatcttttgttggcatatttccgtataaagtttgttccttttgctgtgacagatagatattcagtgcacgaagagaggattttttaaaaatttttgattttactttataaaaagttaggctttcagaatcagtaataattttatcttgttgatcaacaaaaacagtaatatcctcaccatcttcggcctcacggacactggcgccggcattattaaagtaaaattttttgaaaaattcaaatgattttctaaatgttggtgtataatttatataatcaaaatttgctaaaacaggaagcaaactatagtcaaatttaaatccttttccacttttttttataaatgtttttgttgctggattctcaagataattaaattttacctcggatttaatagtagcaatcatttgatcaacttcaagttcttcgcctttaaaaactccttgataaagtgagttataaactttattggttagttcttcagatgtatttttcagaattattcaaccatctaaaagtgttaaattatttttgggacggataattgcgattgtattttcctcttgaagttcttcgtaattatcctttgaaaaatgagcatcaagtgcatcaccattatataaaagtgctacatcttggtttaaggatgggtcaattattgcattaactagttcaagtcctgaagttttaaagacattgtgtctgaggtcaaaatagtcaaaacctgtaatttcagcaatatatttaataaaattatcaactaaaaatttatagttatctttggtaattttttctccatatttaccaattttttcactaccaattaagagattatcacgcattgcctcagttcattcaaaaaaactaaaaccgttttttgataaagttttgccaatccctgcaagactttggtcgttaaatttaattcctttttcttggatctgagatctaaattctggacttcagtttttttgaaatctacgtaaattaactctttttccgtccttttcatagtcaccaatgatataggcaattactttatcctgggtaaaataaggaataaaaaattctcaaaaacggtcttttattccatcattatcggtgtctaaatcctttttagggtcttccgcttgtttcataaactggtcatatttatcgatatgctcaacaatttcaggccgaaaaatttgctcgaaagcctgcctttttttatcaataaattcctgtttttcctttaaagataaattttggtaattttctggttttctaaaaacttttaccaaatctcaatttggaaaaagttttgaatagtcaattttttgcaaaagtcctttttgtgctaaacgagcaatttgaaagtctgaaccaacacctgcaattgtccgattatcctcgattgcttttgtaaattcactgatatttccaaattcccggtaattaaaatccttgttaataaattcgcgtccttgatcagatatataagattcataattataaataacgggtttaaatccaaactgtgattttaaaaaaaatgctataaaaaaaaggataattagacaaataaaagccgcgaatttgccaaaaagatagactaatttgtttttcattttccaccttttttagtcttataataaatccagataaaatttgaaataaataggaaaaaaagcataatagttcctaacatcaatgctcaagttttaaaagttccttggtataaaagtgtcccgactgtttgtgcatttgaggtaatttttgtaataataaaatcatcaaaagataaaaaaacaacaacaaaaaaagtcgaaattatcgctggaaacatatgttttagataaattaaaaatcaagctttagttttagaatagcctaaatcctgggctgcttcgtataaattaagggaaaatttttcactttttggaaataaaaggagaattccataaggaaaagtcattacaatgtgtgaaataattgcccgatataaaccttcactggcagccgaaagtgaaccaaataaaaaacttaaaattgttgcaagtgaaattgctgtaattacatctggattaattagcggaatgtttgagcttaaaactacataggtttttattgttttatttttttgtcgccagagagcaaaaactgtcaaaagtgaaagaaaaacaacaacaattgctgcaaaaaaagcaataattactgaattaataaaagcgctagcaaaactttctttgctaaattcatcaaaagcatgcaaggaaaatttatttaaagtatttgaaacaaatcctttttttgaaggtgaattaaaagaaaaaactgccccgacaataatcggaatataaaaaagaataattaaaaatcaaacgtatgattttttcaaaatttcatatttttggaaaaaatcaataattttagtcatatttaaatcctttaattttcattataataataggaataaaatgaattagactataaattccaataaaaactagcagggtcaccaaaacaagcgatgaaacccgggcaagatcaaaaggattggaaatatttgcagaattattaatcaaattgccaattaattggttttgtgatccatttggtaaaagtttatctgaaaccacaattgaggtagctgccattaaaaaaacaagcgcaaaaccggaactaattgcccgaaaactataaggaagaacaacttttattaaaagtcaaaattttgaataacctaaatcagtcccggcttctagtaaatttttgggcatatcgcgaaaaattgtatataatggcagtaccataaatggaaaattcaaaaaaattaaacctaagaccataaaagaattattattaagactaccttcatcaaaaagtagtaaaaataaacttctaagcgcaaaaactttagcaattgtgaaaataattaaggggctagctatcaatgaaagcgaataaattttgaatatttttgatcttgaatttgcaacaaaaaaagcatagggaaatgctaaaattaaacaaataaaagccgaaattagaccaacaaaaattgaacggccaataatttgccaggtagttttttcctttattaataaatgattatcaaaactttgactattatgtacaagcggactaactgattttccaaaaagtaaaattaatggaattatcacaaaaatcagggcaaaaattacatagggaattacaagactgatgcgcggatttaaactttttttgaaattttttcaaaaattttcaaaaaaattaaatttcagcattttccatctccattaaatgaatagcatcatcatctcattttagaaaaacttgagtctcgaggtcataaaaatcgttagtttcgacattaattattgtattttctactttgatatcaagtgaatagtatgaacctttataaatattttggataacttttcctttaaaatagcctgaatttaggtcaatatcgatatcttctggacgaatcaggcaatctaatttttggcctgggataaactcatcatgaattgtatataatttaagaccaagaatttcgacctgattttttttaatgtattttgcctgaaaaaaattagaatcaccaataaaattagccacccatttattaactggatagtcataaatttgttttggttcatcgtattgggcgatttttccattacggattatggcgattttatctgataattgcaaggcttcatcttgatcatgagtaacaaaaataaaagttaggccaagtttttgttgaattttttttagaaaaacttgcattttttgcctaatttttgtatctaaagctgataaaggttcatcaagtaggacaatttcaggctcaattacaagcgatcttgcaagtgctacgcgttgtttcattcctcctgataattccgaaattgctcgattttcatttccagttagaccaacaaggtcaataatatcggtaatttctttattaatttcctgttttgtgatctttcgggttaggtatttttttttaaaactttctgatttggatgttagataattttctcaatttgaatatctaaaatcagaatcatctaatttatcctgtaattttttacgttttttaatatctaactgtggattttcaagcagtttttctaaatgagcctgtaaaatttttaactctttaatctttcgcttttgcttatcctgtcattttttctttaagtgctcaaattttttccagactacatccggaatttcttctgccttttttttaattctttttaatttaagaccaaattcaatatttccacgaactgataaatgtggaaaaagtgcataatcttgaaaaattgtagctgtatcacgtttatgtgccggaacgtcttttatatcgatgccattaaatttgatttcgccgcgagtagttcattcaaaaccaccaattaaacgtaaaattgttgtcttcccggaccctgagggccctaaaagtgtgacaaaatctcctcgtttaatgtccaaatttatttgatctaaaacttttttatcaccaaattctttatcaacatcaacaagggagataattatttcacttttttcaatatttttcattatttaaattttccccttaaattagataaaataaaaataacttctaatttgaataaaaaaatattttattcttaaaaaaaatatgaaaacttcatctttgaagaaaaaaatcttctctaatgaagaataatggggaatctgtcaaaaatattaagtgaagcggattcgaaataaaaagcagcatcatcaaaaagtgatgcttcaaatatataaagttttaataaatgtaagtactttttctcgaattccataggtagaataaaattatattatatttttaatattttttcttaatttaaaaaaatttatatttcaaacccttttggatgctaaggaaaaactaatttttatgatataattttaattttgatttgctttttttggtaaattaaaaatttagtgttatagctaaattagaagaaggagaaaaaatatgtatgataaatttaatagaaaatgtagttgtaaaagcagagcaaaataacaaaatcccaaaaaaacaaatagattattttattaaaactgctaccacattagagagttttctaaaagataaggaaataaaaaaatatattacaactgactactccactagttttatgcattcaagtagtccagaaaattttttgctaaaaaaccaaatgcccgttatggttgcgtttgctaatttcaatgttggacacaatattatcatataatatggttatgacccaaaaacagaaaaatatttagtaaattttggttgggagaattattctaatttagttatttcaaaatgagatatctgaagtttttgatcactagggtattggtgatcttttaaaattgatgatgatgatgatgatgactataagaaaaaacatcccccaaagcaaaaattactgagtaataacggtcaaattttttcctattcagaaatatttgaaaatgatcaggaaataaatagaaacggaaatattgtcagaaattacgatatttactaatttattaggaaataggaaaagcaaaaggaactttaatgcataaaagcaaaactggaaaaaaatcaagatataagaatttttttaactattcaaaaaataattttagaaaaaattgacttttaagtatctttttttctattttttcaattttttcaattttactttcattatttttatggcaattgaacaaaaaattcgacacacctatttataaatttccagaccaacaaattacaattgtcaaaaaaaatggccatgcttttaaaaattaagaaatcaaagaaattgaaaatttaaaatctgtgacttcagtttcaaaaggcgaatcaatattagaattcggcggattttctaattcggattcatttggttttagctcttcgcctacttgaattaaatcagttgatattaattctttttctaaaaataatatgaaaaattatgttaattttcaaggacgatttttagaaaaagacaacgaaataatagtttcacaagattttgcaaatttaaaagatgtaaaaattggtgacacaattgaatacaaatacaaaatacctgatgttttagctaatcaagacccaataattcatcgcgaaaaatttaaaatagttggaactgttggatatattaatactagttcagatttttatattttaatttcaaacaatggttataaaaacttagttaaaaatattttcaatttttcgaagaaatttttaattcaagacaaaacaggcaaaaataatgaaactgactttgctaaatttttgattcaaaatttatcactttatggaataaaaaaggaaatttcaaaaaacagtcaatttccaaaaattactgaatataaacagttcaattttataaaaaatttcagccttgataacaatgttaaaactcccatatctggaaaaattcctgcaaaaaataatgaaattcttgtaaatcaaaaattaattgatctttttaagcaaaaattaaatcttaatttaaatataggtgatgagataaattttacattgcaaaatcccaactttttattttttaaagaccagctctttatcttcaaaattagcggtatttttgattctgatgaagcaagtcagattctatttaataaaaacgtagttcaagtttttgataatgcactagatgataatcttcctttcaaactagacatttttcataattcaggcgaaaatccagtgcaaaatttactctcaaaattagaaaaaaagggatatgaagcgattaaaaaattagaatatgaagctcacgttggagtcgctgagatttggtcagtaattcttggcgttctaattatgattattcttctaatatcatccttttttgcttatggttttggtttaaaacaactcaaaataaataacctaataattgatggtttttctgcaaatgaaaataaaaaaatagtaataaaaaaaataaattcatactgattttttatcttaagtcttgtttttctaactagttttctcttgtttttcctttctagtcagttaccattttttaatcactatcttgaaaatagaccaaaaaattacataattggccgaattagtttagatcttttttgaatttcattagtttatcttatattttcaacaattatttttgaagctaccatttattttaaatactggaaaaattttgtgaaaatcaaaaatgtagcatcaacaaaaaggctttagaaaaaattgccttaaatttgtaaaatccttgctaatttaatcaaacaatttacaaaaagcctataaaaacatacacttttttactttttgattgattctaatttttgtaaaactgttgcaacatcaccgatttttccaataatcgtaatttcatcatttaactgaattattgtctcggctgctggcaagaaagtttctttatttcttttaattaaaaccacattaacattaaattgacgtaaattcgcatttctaatacttttgtttatataatgaggcgattttacattaacacttccggcaaaaactccatttgcaatttctttaagactatcggcatagttaagaaaatttttatccaccgtcaaaagcgccattttaattccagcttcttcttcagggctaataattcagtcaacgccaatctgttttaaaacccgcgcgtgccttttatttactgcccgggccgctatttttaaattattaaataaattaatttcggcctgtaattctaataaagttgcaataatttcaatattatctgaagtggctactataatcgtgtcaatatcttcaagcccaacctcatttcgcatcgcgttaatatcacttgcatccataataatgggttctatagtcgcaaattcacgaataaatttaagattttccgctttcttatcaatcacaatcacattatgacctgattcagcaagctgggaaattgccgctctccctagtcgccctgctccaattatacagatatttgctcgtttcatttgactaaattgtagaccaaaattgaaaaaatttttaaaattatccaaaaaaaataaatttaaaattttataaataaaattttttatctaactaaatcaaaaaaacacttttttttatagcattttttgattgatataaaaaaattatttttcttttagatttttgcttttgatttttataaaaactagtataattatatcactaactttgaaaaatgggcttattttagattttttagcttactgatatataaaaaacactagaaaacaaggaataatttatcaaaacggggaaaaatgaatttgaaaattaatttcaaaagttttctaaaatcactttttcggctaaaaaaaattcatataatttttgctgtttataccatagttatttttcttggtgctggctttttagttacgccttttgcacatacaaacgccgttgacaaaattagttttctcagcgcactttttacttcagtttctgcctttagcgataccggacttagtttggttgataccggaacaagttttaatgtttttggccagactataattgcaattctgatctcccttggcggaattggaatttttgcggtaaaattctatatttttaacttgatttttggaaaaaaaattagtattttatctcgtgaaattctcaaaattgaaagaggatcaagtaggttaaatgatctaaaaggtgtaattaaaatctcaattaacctctttttaattctagttttaatttcaagtttggcgctaatgcttcatttttattattatgaaattagcccaaaaaaattctctttccaacaaagtccatataaaaatttagttttatcactaagatttgcaatttttcatagtatttctgcaatcaataatgctggttttgatataattggcgcctatagtttcgagccttattattattcttattttttgcagattattattataattttaacaatcattggcgggattggttatcccgtaatttttgatttttatagttattttcggataaaactatcaaaacagaaagtgaaaaactttcgcttttcacttttctcaaaaatttcacttttaagttattttgtaatttcgttttttggttttattttatttattgcttttgaggcgagttcaaaatccaatcttactttttgaaatcaggtcgaaaatggtaactgatttgataagtcctttgcacttttatttcataattttatgtcgcgttcgactggttttttaacttttgatctaaaacaactttcacaagcaagcacgtttttaacaagtttattaatgtttatcggctctgcgccggcttcaacaggtggcggaattcgtgttacaactttttggatttttatccttgtaattatttcaagaattcgtggatcccaagatgttaatgcttttagaagaaaaattactacagataaagttgtttcagcctcaattgttttctttatttcacttgttttagtaatttttcttgtttttgttgctagtttttcccttgatgattcaattaatagaggcaaaactattccataccaaattcatcatttaatttttgaagttacttctgcttttggaacctcaggactatcaactggactaattcgcgacttgtcaactgtttctcaggtcggatttatgattataatgctgattggacagctcggaattacttcatttatttatgtttgacaaggcgataatatcggaaaacagaataaaacttatattacagaagatattttaattgggtaatttatatacttaaaatttaaaaaacactataaattacagtaagttagtatactgatttaacctaaacattgatttttatatatttttggctttcttattccggtaatttcaatttataatttaatacaatataaaaaaatatggccgttctaatctaaatttcagttttcaaagaaatttttaaaaaaaacctaggtttttttaaaaatttctcccgagtttcccagtttgatgagataattttaaaaaagtgtccggtttcccgtgcttttttaagttttttgccaaaagttaattacctatttttttactgatttattaagatatcaaagtagaaatcatacctatttcaaatattgggattgctaggaacaccatcgcgatttttaaatatcatttgttgatctaaagtgttaaattcaaccctttgtcttaatttttgcaacatcgttactaaaccaacttcagttaattgactgtttgcaaataacttgttatcactaatatgtttgttgattttaaaaattatagtttttaaaataactaatgagataaagcacaaaaatgtatgagctaggatatgctcatctattcttaaaaatacaggacgaatattcaataaaccttttagacttctaaaattagcttcaatatttcactgtttttggtatttttcaactatgtctaagacatttaaatttagtatatttgtttcatagacatagtaaccatcaaattgtttgtccttgtcaattttactttgatctaattcaaatttcatatttgaaatttccctaaaatatttaggttttttaccaaacaatttgtttacttcaataaaaccatctttattttgttttttaataaaactttggatttgctcttcgcgagccttgctgtcttttattgctctttttttactgtaagtaataactcttcttctaatattttcagtgtatcttttatttttataagatgaataaaattcttcttttttatacttaaaatctgcatttacatcaacataatcgctaggatctaataaataatctttaaatttttgactgcctatctttgcacgataagaaataatgaaattatattcttttgattcaagaaatcgaatatttgcagcagtggacatgccacggtcagcaattattgtcatatttttgatattatatttggattcaatatctaatacaaaagggattagcgtactagaatcggctgtatttcctttaaaaactttaatatgaaaaggaatgccatttttatcgcatgctaaagcaatgacaatttgatcttctttgaatttagcatctttagaatagccaggaattcttaatccatttctttcaaatgtctcaaaatagactgttgatgaatcaaaataaaattcattgtccctttttccaagctcgcttataaccattttgttaagactatctaaaagttgattttgtgattcatagacaagatctaagagtctataaaagctatttttggaagtatttatttgatttgagtaatcatcctttttatcaaaagcattaataatgctaccaggatcagtaattcgctttgaaattaagtagttaaaaatttgtttcatatttttatgcctacttttaggaagtgattcaaaaatattgtgcttttcaataagtttttcaattaattccccaccaataaaaaccgaaccttcgattatggcagaatttttaagagaatcaagtaaagttgtcttgattttatctttgtcatctaaatttgaaaataatttcaatttttctttgataatttgaatagcatttggattaattttttccaaagtttgcacatttcctatactaaatcaacgttttggagctttcccataaccttgtgttcagccaacatatttatatattttatcttttgaagatcctcaaacattaaacaaaatcaaattatgctttttcataatttataattataccataaaattactttaaaattgtaattaattgtaattaataaaaattaaggttttacgggtaaaaaacaccgatttacggcgatttctgcatattcatattcactaaaaagtgaattttcgccatcaaactgggaaactcaggaaaaaaatatggccgttctaatctaaatttcagttttcaaagaaatttttaaaaaaaacctaggtttttttaaaaatttctagattgtttattgcttaatgattatcagctttaattaaaatccttatttttattagcaattcctacaaaatgaattcgtgcaatcgaaatatatttgttccccatcttgttattaaagtaaattattatcttttttaatcgttttttaacatttactgtaactgaaagttggcccccgactccgataattttttccggttttgcaatattttcctttggtaattgatgaatttttccttccatatcctcatatgaaacactaatataatcgtgtcatcaattgtttttatgaaccggcgtatagtcaccattatcaaaaaagcgtaggcgaaacgtttcaacataataaccatgcggatattgtctaacattttgcggaatcattttaaattcactagctttatcactccagttattatctaaatatcagtaagtatttccttcgtcaaaaacgttttctggacgatatttatacccaaaataagttgaatattttgtatcaccaaaaccccaaatttgtcttggatttttcaaaatgttataatttacatagttaaaatgctctttttttagaaaacctgtgaaagtatttcccaaataattaagctcatatctaggttctaaataagtcgttaatttttcatcctttacgatttttaggtcactaaaaagtgttgaatttgtttttgttagtgctaattgaatttcgctttcggaaatttcctgcggaaattttcacaaattttgttttgcaaattcagctcattttttgtccatttcagttctaatatcatcaaaacttgttaattttattgttgtagctgaatttttgatctccaaaatttccttttttggattttgttttcaagtaaatgattttattatataatttccagtcttaattttttcaatttcagattttagaaaattaaaactgaatttaaagtgaaaattcgattttttatgagcagaatttgttgctgaattacttagtttttcaatttgtgctttgtaaaatttaagaaaataatcctgtttttcttggttttttagttccaaattaaaaaataaattactctgacttaaatcaaaatttgaataaacttccaaattaagaagtttatttttttcatctaattttaggccattcaccaaattaagttcgctttgaaaactgaatttttctgaattttctttattatagtaattaattttttgttcatttccaaattcaatagtttcaatttggtacttttcgtttatagttaaatcttgaaattttagctttaggtattgcaaattagtcttgtttttattggatatttgattattttgactagagttttcaacagttgcttcgacttcaaaagtctcatttttactatttttataaataatttttgccttgtcgttttccttaatttttcccagattgtcattaaaaggaattattgcatcaattgaatttggatgctggcttgaaaaaacaggaattgaatccttgaaaatttcatttacaataattttactactttgcgacttatcgaccgtaattcttgtattatcagaattttttaccgccactaattcataaaaagtattagtcttttcaagatttattattgttttgttatcgtttttcccattcttttcaaaaaattctgactctaattctttgtttgtggagttccctatttcacggaaaactaattttgcttgtttggcactaaatttatttccctcagtaaattgaatttttagagttcgttttttatcaaaaggtgatgagctttcatcagaaatcgtcaatccgactgtgtttttaatagttataaactcaaatttttctgcattttgaccatttgcatcataaaaagcgccttgttgattgtttaaattataattttttcaagctttttctggtttattattgaaaaataactgttgaattttgtattttgtttcacttttaagtcctataaaattaaaatttagcacccatttttcattagtttttttaattctaccttgaaatttgcctgttttttcacctttttctgttgttaaaaccgcgctgattatttgattttcaccaaaaacattatctaaactttttaattcgacactaaaatttgccgaattaattgttaaatcagtaaattttgcactatctttgacaacttcaattccttttggttcaattttaatctcgaatttattaactgcaactcatttttcgtctgtttcaattttttcaaaagtaaaaattctattagaatcaattttttcgaaaacaaattcagcatcttcgccttgaattttgtttgaaatagatcggaaaatttcattattactttttaggactaaaactaattttttaccattattattaagtatttttgcactaacaactaatttatctgtagaaaattccttaaacttgagttcctttaatgttaaaatcgcggtatcaaagacaaaattattgctaaaatcaattggaactaccttgttattttggcgaaaattaactttattaattaaatattttttgttattttcaagatttatgttgtcaaaaactagttttgagttaaaatttttaaaattagttgccactgtcttattagttttggcatctttttcgttaaaattcacattaacttgaatgcgatcgagattaatttgatcagaagttaggtccatttttaatgaatcaaaatttgtttgctcaatttgtttaagttcaattttattttctagtgaaaaaagatttgtttttgcaatgtttttgtgaaattctgatccattttctttttcaagccataattttttttgaattttaaaaggttctaactttttaatctcaatttgtttattaggtaaaacattaaaatgaaattttagaaaaagtttgtcagcttcttctaaaatttcaccgatagattcaatatttttttcgccttcacttgcaaaaattttaactatatcaccttgttttaatgttttattttcatcttctaattccaaatttgcccaaatttggtcaataaaatcactttttagttgtttgatttcttttaattttattggttcaaaatattttacaaatgaaaaatcttcaatattgttttgaatcttaatatcgtttagtttattttttgaatcataataatgaatatttgacaaataatattttttattcgttaaaattttgtcaaaagaaaagtggtataatttcttatcaaaatcaaaatatccatattttgaggttaatttagtttgtccatcttctgaatttatcgtcaaaaccaaatttgaagatgttaattcaggatcaataaaattaaaataaacatcaacagcgtcttcattttgcgctactttttgaattattgaaaattttttctcctgaattgtttcattttttgaagattctgtattttttggtagtaaaatttttgcctgttctgaatttttagcaaggtttttgagtggttttttaacatcaaattcaacaaaaagatcgtttaaattgattggttgattcatttttgttttctcatcaaaaaaataaatgccgcgaagagccaatttttgatctaaatttagtagactagaggttagttttgaacttgcaccggttgaatcaacattgacatttttttcaattttatatccttcctcattttttaaaattaaaaaaacatctcgatttgcggtaagatttttgttaaattgtaatttttcagttacggtatttcaaaaaacaggtttaaaaattggcgcattttcataggtagctttaaaaatttggtatccttgaatttcgattgaagttaatttgaaggaatcatcaagatttaaagggtgatttattgttaaattaccgagtttgtcaacttcaaaagaaacaaactcggaatcaaaatttttattttggaatttagaccttacaattttacctgcaaattctttactcaagacaaaatttactaaaatatcaccatttttattatatttatattcataattataaattctttcataatttaaacttcttgtactcaaaattataatgcccgaaaaagatgaaaccacaatcccagcgattccaaagattaaaaacaagttttttttgacaattttcattatttttctcactttttttctttttttccatcacagaaatttaatttttgttttttttaaaataaaaagaaaatgatctattttgtagatttaaaatcaaaatagatcatttaaaattttattggataagctcaggaaattcaattttaaaaactagataattttatcacaaaaaaatataaaagtaataaaaaaatttcaaaataccttatttttaaacattttaactctaaatttaagaaactaaaataaaattttaacacattgaattttgcttaaagaagctagttaaaacaaaaaagcattaaaaatatgcttttttttaattatttataattcaatctaaaattttttgctttgataaatcagaatcattcagaatttcttcaactttttctacatcaataaaggcaaggccgattttttgaatataatcaatttgttcagaatctttaaccgcaagcccaataacaaatttaacaggttggccgtctcaattaagtgtgtttttgaggtggacaatttcgatgcaatttctaaaaattagattatttccttcaaaatttccgtgcggtaaggctaaaaaatttcctaaagctactgaagattccaggtctcgtttttccattgactgcaaatattcaaattcacaacagtttttttgttggaaaattctaattaatttttcaaaagcttgcttttttgaggtaataatttgatttaaatgaatattttcgagttttaaattcattttttcagccttttcttttgatttttataaaaatttagcactaatttaatttcatttatatctaaatttgtttgattttttaggaaaaattcgggactttctgccaattttttctgcatttcgagcgcctgattgtcattttctcagtcaaaatttaatatataagcaaaagtttcataaataatacttaacttttcagatgatattttcgatttttttgcatattttaataacaaatcaaatctttcgttttttgaaatttttgtaataggatttcttgcaactcgcacaactaaatcttgcaaaacgggatttttgaacctttttattgtggtttcaaaatattcattcattattttttgttctattaagggatttataatcaaaactgtctgttgtaaaacttccttcattttttcaatataattttgaattatgacggaatttagcgcctcattaataaaattaaactttaaattataagcaaaataggcaattcctgagtgtaaggcattgacaaaaaacaactttctaagaataaaaaaatcgagattttccaaatattcaacagtttttagcttaattttttgttgcttttcctctaaaataatttctgaaaatgtttctgtataaacgtttaaatcatttgaacttggcgcgatttggtcaattgttgtatcaacaaagtttcaaaattggcacttttccaaaatagtcttaaaataagaacttactctataaccattttcaaagcaaataatttgcttatgtttttcttcaatttttgctaattttgcaaaaattgatttaagaaaaaccaagttttttgcgccgattgaggttgaaataatatcagctgaacttaatttttttaataaattttccttgttatttaaatggattgcttgaaaattagttattttatatttttcaccattttcaaaattaatgacataataaaaaccgttcttattcaaatcattaaccaaattttgattaacatcgacaaaaataatttcaaattgattttgatggtatagttttgcaatcaacccgcgcccgatatttccggcgccaaaatgaaccactttcattacaaaaatccttctttttcttgtatttttttaattttttttgctaaattttcataagattttttatctaaaaattgagttaaagtaataatttttgctgttgaatttttcgctttaacacgatcctcaagactttgaattgtgatgataatttcttcagcccctgttaaatctgcaattgctaaattagtaatttcaacatttctaattccattttcctttaaaatttttcgaaaaattgaggccgccatcactgaagaacccattcctgcatcgcaagcaaaaacaatttgttttcaatttagattattttcagttggtttttttagttttattttttcactttctactaattttttggcactttctaaggcaaaagtttctttttttgttttttttctattaatcaacttagccaaaaaattaactcctcaagcggcaactaaagtcgctaccgcagagccaaaaattccaattgtaagcccaactagtgaatttgttgatttttcaacttgaagatattgagcaataattgaacctggcgaaacaggagcaactgcaccaacattaaaaatttggaaaattgcattcgcaaaaaccccgcctgcaattaaggccaaaatcaaaattggccttaaaagtgcaaaagggaaataaacttcgtgaattccgcctaaaaaatgaataggaattgacgaggttgcttgacctttaataattttctcttttgaaaaaattaaataaaacagcaaaagtcctaaccccggtccgggatttgattctaataaaaacaaaattgacttgccggtttcagtgacttgaattgcacccaaagttgtaaaaacgccgtgatttatagcattatttaaaaagagtatttttgcgggttcgacaattaaagcaattagtgggtataattttcactgtcccatttttgctgttagaatcccgagtgattttataaaatatccaataaaataaattgataaataataaactggaagaagcagaacaaagccgagaatgccaaggtaaaaattattcaccaacatttgatagccacttggaattttatgaatccaaaatttttcgctatgttttaaaataagtgcagaaactgggccaaaaagcataactgaaactagcatcggtgcggttccgccagtgatttgggaaaaagtctctgattggccagcggcgactgatgcaattgcaacaataccagcaattgctccgccccgcattttataaattttatatcctcctaaaaaacaaattaaaattggaataatatagacaatcccgattttgaccattgttgctagttctttatttggggttcagcctgttgggataaaaaaggatgtcaacaaacctcaggctataaaaatcccaataattggcataatcatttggcctaaaagtgagccgaatgcctgaattttagttttaagcattttgaacaaattagccataaaactcctttttcttggtataatttttaaaaatgaatagtaatttaattgatcaactttcattgttattaaagcaaaatcggaattttattgataaggaaattgccagttttttgcttttaaatattcaaaaaataatgtctttaaagttggaaataattgccaaaagtgcaaattgttcaactgcttcagttataaaattttgtaaaaaactaggttttaaagggctaaaagatttattgcccgctttagatcgcaattattcgtatttaaatttccaaaaaaaacgttattctgagaacaaaattagtcaaaaaaatcaaattttaagcaaatatcatctgttgataatgaataatcttgataaaatttataatctaaactataattcgatgataaaatttgtaaaattattacaaaaaactcgacatataatgctttttgggaaaggctcaaatttagaatctatcaatatttttgcaaattatttatcaaaattgcaatatcatatcgattatcattatgattttgaggttcaacaaaaatggactgaaaaatcaattgactcaagtgtttgtgttttttttagtttctccgggatgcattcaataattgatgaattagttaataaaatgaaagcaaaaaattgtataattgtcgcttttactggaaattttgaaagtaatttatataagcaatctttaattagttttttaacttttaaaaatgaagatgttcttgaaaatcacacctctgcacgtatttcttttatatatttagtaatgcaaattattaatttgttgaaaaattagtcggtatttttatataccacaatcaattttaagtttttaaaacgataatttatatttttaaaattaattttacaaaaagaaataaaaattacttttttattttaaattttttaaaaaataaaaaaagactaattcactttaacattttatgttaatttgaattagtctttaaattaaagaaaattttctaatttttaaaaccaaaaaaagcaatttaaaaattatactttaatttatagtattttttatttttggagtattaaaattttaaaaatataaatagataaattttttatagtaaatttgaaaaaatcattcttaagcgggtttagctcgatttttaaagtgttttttaataattccatcaattatgaaaacaaaatatacaaaaaggctcaaacctaaaattatatatttcccagcttttggaatcagaccaagaatcccgggaatataaccaataaaatagtcagtatctcctcaatttagcgtaattagtgattgtttattagtcccttttattaaatttccaagttcatttgtagctaatggcactcaatttccaaggccaaaaaatacaggaataaaagtgataattaacccactaacaaaagaaccaataactgctcctcatattccgcctttgatatttccaaaaactccagaagttgcccctagaaaaaaatgaggtacaagtcctggtagaattattgccggaataagtgctgaatatccaagtccaagggtaataaaaaatccaataattccggcaaaaaaagaagaaataaagccaataattatcgcatttggggcataggggaaaaccactggacaatcaacagcaacttttgcatttttaattaatttatcagaaaatcctttaaacattggcactaattcaccaataaaaagtctaactccaaaaaggataatttcaactccggccgtaaaggtaaaagccgaaattatcattgtaaccacccaatttttttgtgctaaaatactaattacacctgcatcggcagctttgtcaaattttcctaactcatataaaatacctgcaggtaaaaaagcaaaaatataaaataagaaaactgtcagtgaaattgaaactaaagtatttcgaaaaaaatacagtgactggggaaatttaatttcttcggttgaaagtggcttttttttggcaatttttgcaattccttgaccaattagtcctgaaagggcataaccaaatccgccagtatgacctagggcaatttcatttgtgccggtaatttggaacatatatttttgctgaactgacggtgaaactaccatataaatcgccaaaatacttgatccagcaatcaatgccattgcaaaatcactcgaattattttgaaaatcataacccgaagtatacataacaacggctaacatcagtgacgaataatataaaacatgtccagaaagatagacatattttagtcgtgaaaaggttgcaagaataatatttaaaatcattgcaatcaccataattagcgagcctaaagtagcaatacttggcagactttcagtgagagcgccagcaaaagcatcattatttggaatcaccccgtttaaattataaaccctttgaaaaagcggttggaaaaaattaagtgaggaaactaaaactccagcaccaccacctaagacaagaaaaccaacactaactttaaaggaacttataatgatttgtgaaaaacttttacgcattgcaactgcgccgattagactaaaaagtccaactaaaagcgccggtgtgcccacaaaatcttttaaaaaatttaaaagtcagaggccaaaattcataaattatcctttcttttagcttatttttaaagttttttttaattttatctcgagttcttcttttgataaaatattagtcaaaattaccattttacttttatcaaaatcaagacttggggcaacatcagcgccgattataactaaatcaacatcaaaagaatcaaaactggaaatgttagtatgctcaactgagtcataatttatctttaatttttcaaggacagatttaacatttagctctaaaagtagtgaagatcctagtcctgaaccacaaacacatttaattttcattttttaaacctttgtattttttaataatttgataaaattctttaattgttctagaagcataaatttcttttttgaaatctgaattaccaaaaaaaagcccaaattcttgaattaaagcaatatgatcattagaatttggcgcacttaaagtaataataatttttgcttttttatttttttggttattaaaagtgatcatttcatctaaaactaaaattgaagttccaacttctagacaataatcgccaactggggcatgcaaaagtgcgacaccttcttcaagtacataataggcgccgtattttgctgtttgttccatgattgctttttcaagatcgtaagttgcttttttattttcaactaagatccttacgccctcatgaactgcttggtttcagtttttaattttacaaaatttagtcattttttcattaaaaagttccattatttcctcctatattaataaaagcgagtgtcataaacaatataaatgcaagcaaaagaacgccaataaaagcaaaaaagacgattcagccagcttttgttgatgtttttgtttgaatttcttttggttttggcattgatttgatataaaaaaatttatttggattgttctttaaaataattgcttcatttttagacttttgaagtaatttttctagttcaatttcacttttgttttcaagctcgctaatttcaaaatcatataattcaacaagttgtttttttaattctttttttcgcatttatttccccaaagcattaaatttgttgataaaattttgtaataaaaacggataaaacaaaaaatacttctttaaaaatgcgagttttttatatttaaaatatgaattagccactttaaattcgtccttttctaattttgttagcaaaatttgctttgattgtttatatgattgtgaataaattttttgatttagaaaaaaatccagaaataccacaaaaacagttaaaatcaaaaaacacaaactaactattaaatagcttaaaaatgaaaataaaaaacccaaatgaaaacttataagaaaactggaaaaaataaaaatatcaatttgcaatgattttttgctttttaggagataaaaattataaaagtaaagcaaatttactacaccataaatatggttttctaaataaaaattaggaattttaattattttttcactgattcaaataggttttaagaaaaaatctttaattaataaaattatgaatttttgttgatatttattaataaaaccttgttttatcgtttcaagatcaagtttaattgaaatttttagtttagagtatttaatttttagattaactctgtagataaaaaaaataaaaagttgaacaaggacaaaaataattcaagcagctaaaatgtaccaagacaaatttttaagcatttttctccttattaaactggttaattgagctaaaataatcaattatttttttgggaatgtaaattttttgactattttgtcttagtttttttataatatcgttttggcttcaaatttcaaatctagttttgttgtcaatttgattaaaatcaatccgatcatcaactaaaatgacaatttttgaattagaaaatttcttatctaataatttaaaaagtgagtcaaattggcttttagaaaagtaattttgctttaaaatcttaccttttttcaaaaaaataatgttttcatcaattattattttatcaatacccacttgataattgataatattagaaacaaaaaaaaggtttgactcattgacaataagaccaggtaaaactgaataatttagttttgaaaaacgattttttaagagcaaatttgtcataacttttacatcagcagaggcatttataatttcaagagcatcaattgtgaattgttctaccgaaattagtttatattgagatattttttctggggttttttcaaataatcttttgaaaatgaaaaaaatcaaaataagaaacagcaacccaaccgttgaatacaaaacaatattaattaagggcatttttttgatttcctcaaagtctagagaattcagaaaaatttggatatgaaaaaattatgctaccaccaattacaacatcaacgtttcatttttcaaactcaattcaattttccttgcgcaatccaccgtcggtataaattttaatttttttatttatcgaacgaatttcgccaatttttaaaaaaagttgctgatttaagggctcaccgactccgccaattttatctattgtcattaataaaatgacgtttgaacaagaaattatttcgcaaaagtcttcaattttttgattggcttgaatcattaaaccaaaatttatattagaataagacttatttaatcttttaaaatcagtttttgaaacttgttcggcgggtaaaaaaattgttttaaaacctatttgaattaatttttcaactttttcaagtgaatttttacacatcaaatgagcatcgaattcaatattagggaataactttattaaataatttgcaatttggtagtttagtccaaaatttggggcataaatttgatcaacaaaatcaatatgggcgtattttaagccgttattatgcaattttgttaaaattttaattactttaaaaatgttaagtgcgctaatgctttgtgagtattccaacactaaaccccattcacgatttttgtagttaattaaattctacttttttttttttttttgcaagcatctttaaaatttttttcattccaaccgaaaaaaattaaaaaatcatttgttttctataaaaaacagggagcaatgtttaaattagtatattaatttttggcactatcaaaaaaggtgtgacaaaatgaaataatgcaaatctacagctgaagatgaatctaaatacatcaaaattgcaaatctaaagggtaaaaatcgcaattttacattttacagaagaatttagccaaatttataaaaaagaaaaatgcaaaatagacacaaagagtcaattttggatgtatatgaaacaatttaataagaaattgacatataattaaaaaaacaattagaaattattttccctaatcggttaaataatgtaaaattaaattagatttctatttgaaaaatccctaaaaaatttaaaacacaaaattatgaacactcactttttttagttttaaaattttaacatatattaaaaactttttagggaaaatacctaaaaatattatattttaaaagaataagttattatgttaatcaattgcaaaaaataaattacactaaaattcaggcacatttttgcaaataaacataatttcaactatcaaaattactatttttaaatagataataaaaatgaaaaacaagttaagaattttaaaaataaacttaaatcttttgtctttaaatttattaattaataaaaagatctacgattccccttctatctcaagatattttttatttttatgaccgcgaaaatctactctcgcaatttcttcataatattgatctctgccatccaaatccctagaaaagggagggtgttcttctagaattaattctttttcttgttggctatataaattagtattttctagaaagtctgtaaaacgatcaaattcatggtctatttcttttagatatttattcaatgcatcccgatataaaattaattcttccctcgatgattcaatcacatttttagataaattgttataccttggtgatctagaaacaaaaaattcgggatctatgccatcacgcagaaaaatatcttgttcaagtttgaccaatttttgtttaaaataatattttaaaatttcgtatttaccttgataaatattatcatataaatttgaatgaccaaatcagtaataaattttttgattatcaacatacaataaaatgaaattttttaatgcaattggcaaaattcatccttcgcctgatccataggcggggtagtaatatggtttaaatcaaaaaactggcttttttgagtcaaattgggaaattatttcatcaaaaagtccgtattcttgcccaccaaagtaaaaaatttcgaaattttcaagttttaatttcgcccatcttggtagaattaaataatcaggtttatcggggtaaaaatattgaccttcaatttcatattttgggccaaataaaatttgcaacaaatagattaattcaattttatttgtccaattattcacactatcataataagtttggccttttttaccaaaaagttcgatgcaatattttcgatattctgggccaaatttatcaaatcaactaagaataaatttatcacgattttcaatatttaagttaagctttttaatcccgtatttttcaaattttttaagcaaattttcataagtttcaaaagtaaatacattttgaattggttgaatttgggttttttcactaaaattataattctcttttaataacaaattgtaaatattttctacattttgtcctaaatatgctttatttatatctacaaactttgaattatattcatatctatttgataaaaaatcaaagattttttcgtgataatttgctaaattttttggttttgcataaggaacactttcctgtatttccttaataattaaagcttcaatttctcttaattcgctttttgatttaaacatttttgaaaagacagccggataagagattgaaaattcgcatttttcaatatcatcaaagttttcaaagacaacagcaacaacttcttcaaaacctttaccgtcgtataaatcataggaaggacgaagttcatcgataaaatcaaaattttcttttccatttttttcacaatattcaacgtttgctcaaccgccaattaaacacctaatatcattataaaaatggaaattattgagtcttttggagaaaaatgcactttttgtgatatcttctagttttaaattataaatataatcttcttgtttataatttaaactaataattctttcaattgggttaggatagaagccattactaaggtaatataataaaaaattttcataataatactcataattacaattaaacaataactgaacttcatgctcaactatgtttcgaattgaacaacgacttttaatattaatttctatatattttagtttttttaactgtttttttgccttagataatgaatttatcagcttctccatataaaaaatgcaccttttcaatatttaacattttttttctttttataaattcgcgctttatgccccttttttcattccctatcattcttaatcttcttacatgataactgggaaaatatattttgacgtatgattgattattttgagctttacttggttgaatatcaaactcatttttagggttagttcaatcaatagcatcattagctagcccttccccaacaacaaagcgatctttagtaaaaccgatatctttatttaaattattatttggatctgttagccttccatttcctagaatcaaatttgctgtatcttttgttttttcagccaaagttctcataactaattcgttatgtgaataaaaatcaataggagaatttaatttttccctgatataatcacggtcatcttgattcattttatcttttattaaactaggcagcaaattatcaataacaatttgagttaatactgattgggctagcaaactcccaacggctaaaattcaggcttgagttgctgatatttcttcctgactaataacaaaataaggttttaagttttcagtctgaaaattaaaaaatcaagcaagatggattcccgtgtatttttctaatttttttttatcttttacaatagaaagttttaaagtagttgcctttgcttttgttttaatgctagactcacctttttcttttggcaatttttctaagtcaaccacaattgagctttcagttcttgaaataatcgggctataatcaactggcgaatactcacttctgccgttatcaattcatctacgtaggctatcaacaacttttggaacagtttttacagctgctacagtagctgttgttgctgctactgcagcaatggcagctgcaacagcttttgtaataaatggaataaaaggaagaaggaaaaagaaggttttttcaacccgagtttgattttgaagttctctaaagtcaaaaacgtgcccttcaaatcttagttttggtatacctttttcaaaatagagttcagcttttttgttaacaaattcaagtgaagcactatttaaaattacctgaccatcttgattaatttgaattttaatatcatctagattaggagtctctgaatgggtgcttgttttgtttagatgtgtttgggtttttttaatatttgcgttgataacaagcgaattttgttggtttttggcggaaacaatttggactaaatcatcaaaatttagcggtttttttgaatttaataaatctatatcacgggtttcgagtttaaaatctgaatagctttttgtattttgaaaatgtcaaagaggaccaaaaacacttagtgtcagtgaaaagaaaccgacaatattagtgataaacttaaaaagtttcagttttttcttcatgttttttccttatttatatattctttaatctttaagattattattgatttaaaattataacatatatttaagaatttttctgaaaatatcatttaaaaatattgtattttaaaagaataaattaatacaaattagtatgctaattttagacatcttcaaaaaagtgtgtcaaaataaacaatacagattcacagttgaagacaaatttaagtgtatcaaaattgccaaatctaaaggttaaaaattgcaattttacattttacagaagaatttagccaaatttataaaaaagaaaaatgcaaaatggacacaaagagttaattttggatgtatatgaaacaatttaataagaaattgaaatataattaaaaaacaattagaaattattttccctaatcggttaaataatgtaaaattaaattagatttctatttgaaaaatccataaaaatttaaaacacaaaattatgaacactcactttttttcctgagtttcccagtttgatggcaaaaattcactttttagtgaatatgaatatgcagaaatccccgtaaatcggtgttttttacccgtaaaaccttaatttttattaattacaattaattacaattttaaagtaattttatggtataattataaattatgaaaaagcataatttgattttgtttaatgtttgaggatcttcaaaagataaaatatataaatatgttggctgaacacaaggttatgggaaagctccaaaacgttgatttagtataggaaatgtgcaaactttggaaaaaattaatccaaatgctattcaaattatcaaagaaaaattgaaattgttttcaaatttagatgacaaagataaaatcaagactactttacttgattctattaaaaattccgccataatcgaaggttcggtttttattggtggggaattaattgaaaaacttattgaaaagcacaatatttttgaatcacttcctaaaagtagacataaaaatatgaaacaaatttttaactacttaatttcaaagcgaattactgatcctggtagcattattaatgcttttgataaaaaggatgattactcaaatcaaataaatacttccaaaaatagcttttatagactcttagatcttgtctatgaatcacaaaatcaacttttagatagtcttaacaaaatggttataagcgagcttggaaaaagggacaatgaattttattttgatgcatcaacagtctattttgagacatttgaaggaaatggattaagaattcctggctattctaaagatgctaaattcaaagaagatcaaattgtcattgctttagcatgcgataaaaatggcattccttttcatattaaagtttttaaaggaaatacagccgattctagtacgctaatcccttttgtattagatattgaatccaaatataatatcaaaaatatgacaataattgctgaccgtggcatgtccactgctgcaaatattcgatttcttgaatcaaaagaatataatttcattatttcttatcgtgcaaagataggcagtcaaaaatttaaaaattatttattagatcctagcgattatgttgatgtaaatgcagattttaagtataaaaaagaagaattttattcatcttataaaaataaaagatacactgaaaatattagaagaagaattattacttacagtaaaaaaagagcaataaaagacagcaaggctcgcgaagagcaaatccaaagttttattaaaaaacaaaataaagatggttttattgaagtaaacaaattgtttggtaaaaaacctaaatattttagggaaatttcaaacatgaaatttgaattagatcaaagtaaaattgacaaggacaaacaatttgatggttactatgtctatgaaacaaatatactaaatttaaatgtcttagacatagttgaaaaataccaaaaacagtgaaatattgaagctaattttagaagtctaaaaggtttattgaatattcgtcctgtatttttaagaatagatgagcatatcctagctcatacatttttgtgctttatctcattagttattttaaaaactataatttttaaaatcaacaaacatattagtgataacaagttatttgcaaacagtcaattaactgaagttggtttagtaacgatgttgcaaaaattaagacaaagggttgaatttaacactttagatcaacaaatgatatttaaaaatcgcgatggtgttcctagtgatcccaatatttgaaataggtatgatttctactttgatatcttaataaatcagtaaaaaaataggtaattaacttttggcaaaaaacttaaaaaagcacgggaaaccggacacttttttaaaattatctcatcaaactgggaaactcgggaataatgtaaaattaaattagatttctatttgaaaaatccctaaaaaatttaaaacacaaaattatgaacactcactttttttagttttaaaattttaacatatattaaaaactttttagggaaaatacctaaaaatattatattttaaaggaataagttattatgttaatcaattgcaaaaaataaattacactaaaattcaggcacatttttgcaaataaacataatttcaactatcaaaattactatttttaaattgataaaaatgaaaaacaagttaaaaattttaaaaataaacttaaatcttttgtctttaaatttattaattaataaaaagatctacgattccccttctatctcaagatattttttatttttatgaccgcgaaaatctactcttgcaatttcttcataatattgatctctgccatccaaatccctagaaaagggagggtgttcttctagaattaattctttttcttgttggctatataaattagtattttctagaaagtctgtaaaacgatcaaattcatggtctatttcttttagatatttattcaatgcatcccgatataaaattaattcttccctcgatgattcaatcacatttttagataaattgttataccttggtgatctagaaacaaaaaattcgggatctatgccatcacgcagaaaaatatcttgttcaagtttgaccaatttttgtttaaaataatattttaaaatttcgtatttaccttgataaatattatcatataaatttgaatgaccaaatcagtaataaattttttgattatcaacatacaataaaatgaaattttttaatgcaattggcaaaattcatccttcgcctccacaatcaacggagtagtaagatggtttaaatcaaaaaactggcttttttgaatcaaattgggaaattatttcatcaaaaagtccgtattcttgcccaccaaagtaaaaaatttcgaaattttcaagttttaatttcccccatcttggcagaattaaataatcaggtttattggggtaaaaatattgatcttcaatttcatattttgggccaaataaaatttgcaacaaatagattaattcaattttatttgttcaattattcaaattatcataataagtttggcctcttttaccaaaaagttcgatgcaatattttcgatattctgggccaaatttatcaaatcaactaagaataaatttatcacgattttcaatatttaagttaagctttttaatcccgtatttttcaaattttttaagcaaattttcataagtttcaaaagtaaatacattttgaattggttgaatttgggttttttcactaaaattataattctcttttaataacaaattgtaaatattttctacattttgccctaaatatggtttatttatatctacaaactttgaattatattcatatctatttgataaaaaatcaaagattttttcgtgataatttgctaaattttttggttttgcataaggaacactttcctgtatttccttaataattaaagcttcaatttctcttaattcgctttttgatttaaacatttttgaaaagacagccggataagagattgaaaattcgcatctttcaatatcatcaaagttttcaaagacaacagcaacaacttcttcaaaacttttaccgtcgtataaatcataggaaggacgaagttcatcgataaaatcaaaattttcttttccatttttttcacaatattcattgtttgctcaaccgccaattaaacacctaatatcattataaaaatggaaattattgagtcttttggagaaaaatgcactttttgtgatatcttctagttttaaattataaatataatcttcttgtttataatttaaactaataattctttcaattgggttaggatagaagccattactaaggtaatataataaaaaattttcataataatactcataatcacaattagacgataaatgaatttcatgctcaactatgtttcgaattgaacaacgacttttaatattaacttctatatattttagtttttttaactgtttttttgccttagataatgaatttatcagcttttccatataaaaaatgcaccttttcaatatttaacattttttttctttttataaattcgcgctttatgccccttttttcattccctatcattcttaatctccttacatgataactgggaaaatatattttgacgtatgattgattattttgagctttacttggttgaatatcaaactcatttttagggttagttcaatcaatagcatcattagctagcccttccccaacaacaaagcgatctttagtaaaaccgatatctttatttaaattattatttggatctgttagccttccatttcctagaatcaaatttgctgtatcctttgttttttcagccaaatctcacataactaatcgatcatttgaataaaaatcaataggggaatttaatttttccctgatataatcgcggtcatcttgattcatttcatcttttattcaactaggcagcaaattatcaataacaatttgagttaatactgattgggctagcaaactcccaacggctaaaattcaggcttgagttgctgatatttcttcctgactaataacaaaataaggttttaagttttcagtctgaaaattaaaaaatcaagcaagatggattcccgtgtatttttctaatttttctttatcttttacaatagaaagttttaaagtcgttgcctttgcttttgttttaatgctagactcgcctttttcttttggcaatttttctaagtcaaccacaattgagctttcagttcttgaaataatcgggctataatcaactggcgaatactcacttctgccgttatcaattcatctacgtaggctatcaacaacttttggaacagtttttacagctgctacagtagctgttgttgctgctactgcagcaatggcagctgcaacagcttttgtaataaatggaataaaaggaagaaggaaaaagaaggttttttcaacccgagtttgattttgaagttctctaaagtcaaaaacgtgaccttcaaattttagttttggtatacctttttcaaaatagagttcagcttttttgttaacaaattcaagtgaagcactatttaaaattacctgaccatcttgattaatttgaattttaatatcatctaaattaggagtctctgaatgagtgcttgttttgtttagatgtgtttgggtttttttaatatttgcgttgataacaagcgaattttgttggtttttggctgaaacaatttggactaaatcatcaaaatttagcggtttttttgaatttaataaatctatatcacgggtttcgagtttaaaatctgaatagctttttgtattttgaaaatgtcaaagagggccaaaaacacttagtgtcagtgaaaagaaaccgacaatattagtgataaacttaaaaagtttcagttttttcttcatgttttttccttatttatatattctttaatctttaaaattattattgatatataattataaatgtatttaagaatttttctgaaaatatcatttaaaaatattgtattttaaaaaaataaattaatacaaattagtatactaatttcagacatcttcaaaaaagtgtgtcaaaataaacaatacagattcacagttgaagacaaatttaagtacattaaaattgtcaaatctaaaggttaaaaatcgtaattttggattttacagaagaatttagccaaatttataaaaaagaaaaatgcaaaatagacacaaagagtcaattttggatgtatatgaaacaatttaataagaaattgaaatataattaaaaaacaattagaaattattttccctaatcggttaaataatgtaaaattaaattaaatttctatttgaaaaatccataaaaatttaaaacacaaaattatgaatactccttttttttagaattgaaccttttaactttttgcacattttaattattaactttaattataatagttttaatattctgtgacataatcagagctttttaaatacttttaggttataatataccttaaatttgttatttataagacacctttaaataaaaatgaaaaaatttactaaaaaatacggctttattggtttatttttggctctaaatcttggaattttgttggcaaacgttgctttgctaacaaataattgaataaaactgaatccaaaagttaatcttgaaagtcttttaaagtcaattgttgaaattaagattcaaaaaaatgaggaaatttcttttgctaccggttttgttatagataataaaattattactaataaacacattcttgaaaatagcgatgaaattgatattttttatcggcttgcaaatgaaaaagactataaaaaaaccagaattataaaaatttcacaaaactatgacatattaagtttgcaattaaacacacaagttaaaaatcttgaaatagaagaaaattttaattatgccgatgaaatttttacaattggaaacccacataatcttggcttgacaatcagcaaaggcattatttcaggaactaataaattagcaaatcaaagttttgttcgaactagtatcacaattgagccaggaaatagtggcggacctgttttaaatactaaaaacaaagtaattgggataatgacttttcgccttataaatgaaaaaccagttcaaggtatttctttttttctcccttcaagtcaaataaaagagtttttaaattcaaattaaatttttaatattctaaattatttactatcaaaaaccattaaattaatatactccaaattattaaaatttgtgattaagttttactctagtaagaaattgtagtgcgcaaaaactattattaaatcctctttattttttaagatttgaaaaggtaatatttcgacaaagataataaaacgcctcgttaaggctcggatgggtataagccattttttgcaagtcaaaaattgttaatttttgtgaaagtgcaagggcaatttgattgactagaagcgaagcctcttcaaggaaaatgttacatccaagaatttcaaaagttttagaatggaagaataactcgataaaaccggcttcaatttcgccattagcgtgggcgcggggcaaattttttgcaaaaatttttgctttttgtactttttgtacttttaagagtgttttttttgtttatacttgcttttgacaaattaattttttttgggctagttgttttttctttatttttatttggatttagaaatgtttcaatatctaagtttaataattccataattcgtaattcatcaattgcatcaagtaaggcattatgtgtttctaaataattttcatctttggttaacattctgtatatatcttctgcctttcatcctctttttaaattgccgtttttacttgtttctgcatttaattgaatatatttgttaaattgtttgtttttagcgaatatagaaatatcgttatgcttgaatgacttgtgcaattcaggcaaatgtctaaaatcaaattttgtatatgaaaaccaatttttgacttcattagatttcaagaaataaattagttgaacaatcatttcttcgcgtgtttgaacaacattagcatcttgtttaaattcaagaggaaggggagctaaaatattacgggcatacattccacctactgttaaattgttttttattattcaatattctttatcaaatcattgaaaatcagtgctatcagcaattacgactccaacggaaaaaacttcactttgatagtttgtttctacatcaattacagcaatgtttttattcacgttagtaattttttgttttttaattgcttccatctgattcctcaaattcttttttacgtattaggtttataagctccttttgaaattgtttgtacgagtttttcgctaaattcttctcgatttttgatttgaatttcatgcatttcgttatttctaatattccacaatatacctttttccttttctaaggctagcatatatgaagcagtttgtaaaaaatgatcagttgttaaattactaacaaatttaagttcataaactatatcattcttgataacatcagcgattccctgaacttttattctaagattattatcactaaattccaaccaacattcttgttgaattatctcgtctttttcaagcacttttgataatcttttatgcatttgatcaacagcattatcatcaacaaaatcgggtgaaacttgtttaatgtatctttcttgttgtgtttccaaataaacaagaaagagtgttaaatcttttattgaatttctttcactaatataatcttcatagttctgttttagcttttttatttttgctggtcggtgtttataacgttgttcaaaaaaattgataaaaaacctaatttctttatctatatcccaatcatcgaaataagatgcttcaagatagatccctacacatggtgtaagatcaattaaatcatcgtgtgtttgtacttttatttcggttgtatcttcggttttaattttttttacttcaagcattttgaacatattctgaagatcaatatcatacttgtgatcaaacatatcagacattcaaaatgaatcactgtttaattttactaaatttttggattgtttgatgatttcttcatttaatagttccttttcgtcttttggatttgaaaagataattttttctttccctctacttgctgctacacaaaatatgttttttacaatttcataatttgctgtaattggacttaaacgcttttgtcaataatctatggtaaaaacaaaaataacgcaaataggtttttccaatccttttgagctatcatatgttgtaaaaatagccgaattttttttgggcgacaaatttgcgtctctatctcttatagaagcataaacggtttttttattaaaaatatcactatgattttcttcaagataatttaaaacttctgtcatttcatcattaactcagggtcctggccctaaacataagatatcagcaggtttttgtgtagccaaaaactccttaatttcttccagttccatatattggatttgacaatttttgttgactccattaattgttttaccccaaattcgacccaacatattagcgtgttcttttggcattctgaaggaaaatgttaagctaatttttttatatgatcctaaaaatttatcaataaaatcagtaacatttaattttgtattatcgtaaattttctgactaatatctccaactgcaacaatttgtatattaggattttcttgttttattttttccaataaccaagatatttcttcagtaatatcttgatattcatcaattagtagaacatcataagcgccaacagaaatgttatttcttaaaaatattctaattgagtctgcaggggaagaattaataccatttcttcgcaaaaatccatatgcaaatccgtgataattttgtaccataacatttttgtttttaatcttgtttttagcttcaacttttaatagtctgttgtaagttaagtacaaaattcttttatcaataggaaatttgtcgcagagaacctgaatcactgttgtttttccacttccaatacaagcatcaactaggatattttccccttttaatgctaaattaacaacattttgttgctcttctgtgagtttatctgcaataattttctgtttttgtttttcagtttttctagccataattccgttagttattaagtgtaattattaataatattaatttaaaatttaattttactttttttttttttttttttttgcaagtaattctataattttttttatttaatagaaaaaaatagaaaaaaatatagaattttcatatttttataaaaaattaataaacctaatttattgattttttaaaactaataaaaaaatatccttttattaatggatatttttttattagcaagcaaaacaagaaaaatttaaaaaataaatttttaaatcctctttattttttaagatttgaaaaggtaatatttcgacaaagataataaaatgcctcgctaaggctcggatgggtataagccattttttgcaagtcaaaaattgttaatttttgtgaaagtgcaagggcaatttgattgactagaagcgaagcctcttcaaggaaaatgttacatccaagaatttcaaaagttttagaatggaagaataactcaataaaaccggcctcaatttcgccattagcgtgggcacggggcaaattttttgcaaaaatttttgctttttgaaaatcaacatccaaatttaataattgtttttctgtcttccctacagaagcaatttccggaattgaataaattgcccaaggaatcaattctgcgctaaattcttcatcagaactaccgaataatatgtgctttgcaacaatatcagcatgtttgtaggcagttgatgaaagcatcatttgacccgtaatgtcaccgattgcataaatatttggaactgaagtttgcataaatttattgatttttagaaatccacggttatctagatcaatttttaaaccagagaatgcctcattttggggctgacgaccgattgccaaaagaatatttttggttgtatgagcaaaaattttgtcttctttttcaagtaaaagttgcccattttcatattttttgacttttgttttagtaaaaattttcactttgtttctgtctaaaacaaaatttgccgcctcggcaattgaattatcaaaattggcaaaaacacgatcatttccttcaattattgtaatttttgccccaaaactagcataaaaaactgcaaattcaagcgaaattgccccaccgccaatgattgttagttcatcaaattcaattttgcctttaaaaaaatcatcagaagtaattaaatttgctttttcagcaccttcaattttaatttttcttggtttagagcctgttgctataactaatttttcaaagaaaaattcttcattttctgctaaaactgtatgatttgatgtaacttttgcttttttattataaaaatcaacaccagaattttttaatgtttctaaaattgagccttgtaattttagtgaattattttttgctctttgaaaaatttgcttaaaattaaatttcgctactgaatttaatccaaatttttctgcattatcaaaataagatttaatttttgctgatttaagaattgtttttgtaggaacacatcctcaatttacacaagttcctccgagaaattcttgctcaaaaagcgcaacttttttaccatttttacccaaaatagcagctagagaatgacccccagggccaccaccaataataattacatcgtatttttgcattttttccagctttttctgtttttttttttttttttttttgacttttttatttttagtattactactaattataactaatttttgaattttattatataaaaaatacaaaattcaaaaattactaaaaaataactgaaaatatggtataattatagctacaaagttatagctaacctaaatatttaaaaatgatttataaaaatcttagaattgttagtcattctgatgaatttataggttgaattgaacttgataaaaacggaattattgttgatttaagtagaggaaatacagaatcttcaggaattgactgcaaaaaccacgttttattaccggcttttattgattcgcacacccacggcggctatggattttcatttgatgacttttcagatagttgctgggaacaaaattttttagattataaggaaaaactacataaatttgaaggtgtagcagcaatttttggaacaactattacccagcaatgggaaaaaattaaggaaaatagtgaattttttttatttttgcttaataaatatcctaattttttactaaattgatatttagaaggtccgtttatttctgagaaaaaaaaaggggcacacaatcaaaatttaataatcaaaccaaaaagagaacattttaagtttttggcagaaaagtttaacaaaaaaattacagtggtagttgcccctgaaaaaacttcagcaaaattaattgattctttttataaaacaattaattttgcgattgggcattcgaattcttttgatttcaaaaagaatcataatttaaaaaagtactataaatttacgcacttttttaatggatgttcaaattttgaccaccgaaaacaatcacttgtcaaccttatttttgaatcaaaattacctaaaaattttcttgttgagttaatcactgacaaccttcatattaaaaattcaaccctcaaatttacaattaaaaatattaaaaaagaaaattgggttgcagtctcagactcgcttgcccaaaaaggacttgataatggattttataaattaggagaactaaaaattgagaagaaaggtgatttattctatctaaaaaattcaaaacaaattgccggaagtgggatgtcatatttaaaaattcttaagaatttaaagttaaatttgaaactatcttgacaggaaatagttttttgttcctcttataatgtggcaaattcattgggaattctagatttttttgggtcaattaagataggacaaaaagcaaattttgtaattttagatgataaatttgaactaaaaatgtcaatcatttttggccaaatttaccgcgaatttgcaaaatagtctatgaatttaaagcttttttaaaccagagaagaaaaataaaatgttagattcttatgctattttaagataagaaagaattttttctgtcatcttttcaattcctttttcattaattttccgaatatcaaaggcatttggattttcctgaaaatatagtttcacctgttcggaaaaactaactaaaaggtctgtaaaaatattgattttgttaattccacaactaattcctttttgaatttcttgaatcgaaagaccacttgttccatgcataacaagcggaattctatatgcttttttgaaattttggattaattctcagttaagatttgcctttttcttgtaaattccatgagcagttccaaaagcaattgccaaaagatcaggttgagtttttttataaaaatcttttataatttctaggtcaagaatttgctgattttctgcttgatgaccaatttccttcccgccgatttggccaatttctaactcaaggaaaatatttttttccttggcaagttcctttgcttttaaagatttttcgatatttttagcaacatcaaattttgagccatcaaacatagcagaattaaaacctaattcaagatatttttcaaaaagttctaaatcatcacagtgatcaaggtgaaaaataaattttcctggtgaatttttaatcgccgaaacaatcattggtgctagaaattcaatacgggaatatctaattcctcccaaacttaactgaattattaagggttttttagaaatttcacctgctttaattacagcaaaaagtgtttctaaatttataacattaaaagcaaaaattggtttattctctgcatttagttttgaaaatgtttcttttggatcgataaaaaccattattttcctatcatttttttaagataatcagctacaaattcaacatcggttccaataataatttgatatcctttatttccaacacggacaactccacggccgccggcggctgtaatttttgcatctaattcatcattttttgcattatctttaagaattaatcttagccgtgttgcacaatttgagacttcttcaatattttccttacctaaaatttcaataaaatctgctgccattttttgatagtcatcagcaaattttactttatttttagttattttttcttgatcaggtagaaatatttcctgattttgcaagtcagttttttcatctattatactaaattctggcccaattttatcttcacgacccaaagttttaatattaaactttttaatacaaaagaagaaacttgaaccttgaattacaaacattatcgcggaaaaaacccaaattcatagtggatttgccaaaactccaaagttttttgcaaacgcccatgaccttggaaaagaaacaatataatcaataaatccagcagaaaatccaattccgatactcattccagttcaagatacaaacatgtaaatcactgaggtcaaaaaagcatttaaaagtcataaaagtggtgagatgaaaataaaagtaaaaattaaaggctcatcaattccagtaagaaaacttacaagtgtcgctcctgctaaaaaggtagtaattgtttttcttctttctttttttgcagcaaaaatcattgcaactgcagctccaggaagcccccctaaatataacgggaaaaatccggttgtaaacccaccagagccaataattccagtattaaatgcagttatatccccatttacagtataaatttcacctaattttgcaacagtttctcccacctgattaatcacgggggaaattaatttacccttaattggcaattgaaatcagacaaaagtattcaaaatatgatgaagtccaaaaggttgtaataatctatttaaaaatgcataaattgaaacataaaaccctcgagcataatgatttgcactttgatctgatagagctgaaccaattttaattagtccatattgggctcaaggtcaaataattgcaaatatcaaaccaagcggaattattgaaagaattcctaacataggcacaaatctgcggcctccaaaaaaagaaagtgtttgtggtagtttaatatttttgtatttattatacaaaaatgcaacaacaagtccaacactaattccgccaataactcctgaatcgagctgataaactggctttcctgcttttaaaaaatacaaaagttgcgtaaatcctttgagttgaccggacttagcaactaaaacatttttataaattgcctccgctaattggttctgttttagaagtgttgacatcccatatcaaacaacagcagctacaagagcggcctcgccacggttgtctttggcaaaaccaaaaccgattccaattgcaaaaattatcgctagattatcaaaaactattccgcctggggttgaaatcagccttccccaaaatttttgcgtctcggatattccaattgatccatttgctaaaggatcctgaattagtgcaccaattcgtaataaaagtgccgcaatcggtaaaacggcaattgggaacattagtgatctaccaagccgctgtaattgattcaaaattcggttaaaaatcgaattttgactataattttcggccttttttggccgaaaaaactttattttttttacaaatcctactgacattataactagtttttctaaattttttaataccaaattgcactttttaaagttttttctgataattttgatgctgcctttttatctaaaatgaaagtgcaatttggatgtaattgtaaaaaagaagcactaatttctgtattaggctcatcttctaacattgattttgtcacatcggccttatgagagccaaaagagatcataatagctttttttgtatattttaaaattgtttgaattcccattgtaattgcttgtttaggacattgatcaaaactggaaaatttaccttttctaaccatatcctcaattgtttcaggggttaaatttgtcacatgtgttttagaattaaatggagttttaggttcgttataggccatatgaccgttaattccaatgcttatatattgcaaatcaattggttttttcgctattttttcctcataaagtctagcttctttttcaggatttagagctttagaatctggaatatttatttgtgaagttggaatattgacaaagtcaaataaattggttttcatctgttttataaaagcttctgaatgatttttgtcaattccgacaaattcatcaaggttaaaagttgtaattttttcccaagaagtcccgttctctttgcgatcttttactaaaagtttataagtctcaactggcgagattccggttgcaaaacctaggactgaatctggctttgttctaatttggtcgataaaaagatttgcacaatatttgtgcaaatcgcttaatttttcaaaaattaatatcttcattttgtcctttttaatctaaaatagtaataattgaaattttatcacgcataaaataaaaaatagtaaaaaaagcgaaaaaatttttttatattgcaatttttaaatatttgtgatataaataatgaaacactataccggaagcattaaatttttcgctttttttctttttttaaatttaaaaatgagttataatataaaagcatttttaaattaacagcattaaatagttttagataaaattcaaaatttgttaagatttgcgagtagttagctgtaaatgaaagcattagattttgaatcaatttagaatctatttagttttctctttttagtctaaaaatgcgaatttaaaattaaaaggagaaaaatgtcacgttatactggctctatttttagaaaatcacggcgtcttggtttttctattcttgaaacaggaaaagaatttgctaaaggaaaacaaagacgatatgctcctggtcttcatggtctaagacgttcaaaaccttccgattatggggtccatcttcgcgaaaaacaaaaagtacgttttatgtatgggctcagcgaaaaacaatttcgcaatacttatcgaaaggcaactaaaaaaaccggaattgctggaacattgtttttacaagcgctcgaatcacgactagataattcagtttatcgtgctggttttgctgaaactcggcgtcaagcacgtcaacttgtaaatcacggtcattttttagtaaacaacaaaaaagtagacatcccttcatttcagttaaaacagggggatattttcgaacttacaacccggaaagacggaaaaattagaaaaaatcaacaaattttaacctctttggaaacaagaacgccagccgcatgacttgaagttgacaaagataatttcaaggttgtttttaaccgtatgccggaacgatcagaattaaaccaggaaattaaggaatccttaatcgttgagttctatagtaaataatcaattttttaattctaattagtatttttagaaaaaaatccagaaataatttttaaatgtttttggatttttttctaaatgtgatataatttaggtgaaattctaggagaaaaatgcctaaaaaatttgctattacttcagatcatgctggttttaaaagaaaagaagaaattattgagtatttaaaaaaccaaggttttgaagtaaatgatcttggcccaaaaaatgaggaatcagtttcatatgctgtttatggtaataaactagcaaattttttgctagaaaatcctgagcaaattgggattgctatttgtggaacaggattaggaatgtcttatgccttaaaccgatttaaaaaaattcgagctgcgcgagttacatgtgaaaatgatgcttatcttgcaaaattacataataatgcaaatgtgattgcactttctggccgttttaattcaaaagatgaatcaatttcttttattaaaaaatttttagaaaccgaatacgaaggtggccgtcatcaagaaagaattgatgaacttgataaataatgccagaattaccagaagttgtcacggttgtaaacgccttaaaaaccgaggtaattggtaaaaaaattaaaaatgttttggcccgtgatagtaattttatcaaggaaattaatttttttgattttcaaaaatccattgtaaatgcgactattattgacatccaaaatcgggctaaacatatattaatttttcttgacaaccgaaaagttatcttatcacatctaagaatgaatgggaaatattttacatataaatcgcctcaatgaggaaagtatgactatatttcctttgttttttctgataatagcgtcctaaattacaacgatagtcgtaagtttggaacttttatgattcgggatgtggaattattatttaaaactaaaccacttaaagatttggcgcctgaacctttttttattaaggttgatgatttttatcaaaaaatcagaaaatcaacacgctcgattaaggcaattttgcttgatcaaaaaattattagtggactagggaatatttatgctgatgaagtttgttttgcaacaaaaattttcccgggaaaaactgcaaaattgatttctcgaaaagaggcagaattaataatttactttagcaaaaaaattctacaacaatcaattaaacttggcggttcaagcatcagttcttatacatctttgaatgcaaaagagggaaaatttcaaaattttttaaaggttcatacaaaacaaaattttccttgctcaaattgccaaactaaaattttaaaaacagttattgctggtaggggaacatatttttgccctttttgtcaaaaattagacaatttttaagttaaaatactatttttgaagtgttttttagtaataaatttataatttttatggcttaaaagccagtgaaacgcgcaaaaaaccctataattaagtttttttagtttacattatttattataaaattttttatttcaaaaattagtaaaaacattaactaaataaacaaaatcattgaatttttcagtttccaaattaaaaaattcaatgattttttcaggagaaattcctaaattaatatataaacagacataatcaaaataaggattatttagtctaacccactcaaaatctagtagaaaaacgtgtttatctgaggtaataatatttttaaattgtaaatcgttatgagaaattacaagttgatcaaattggtatttctgcactaattttatatattttttatctattatttcactaacgtttcagtcaaatttagcaatcttctcatttttttgcatatgaaattccaagactgcaaaaaatagtttctgcagattagtttctaaatttttagggcttaaaatttcgccctctatccatttcttaataaaattacctttggtgtaaaagaaaaaattaggattatttctgatgaaattctcctcattttttcaatttacaaaattgttaatagcaattcgaatttgaactttatgattcttaaaaaaacctagaaaactgcagttatgatagccacaagaaatcagttggtaatttgtcaatttttgccttatattttttggaaaaacatcgaaatttatagttttttttcaattcattagtcattaaaaaataaaaaaaatttttaattctgactgttttggcctaattcaagatcaaaataaaccattgtatgatcggaaattcctttaattctgtttatttcccctaattgattaattttataattcattgagcgaccatcttttttccgaagctcatcatatttttctacattagcaatattttttttaaaaattgaaaaaatatcaaatttttgcccgttatttgcgacaagattgcctttataaaaaattttatcataggaatttgaatatttgccaaaagtatttgaaagtgaagttttttcttctttatcaagcaatgatctataggaatttagtgttgatttaaacaacttttcagaattttcggcacggatatttgtatcagccataaaaattatttctttgttttcgccgtcttttttatcaatttcaactaataaatttatcaaatcacgagcttctgcggcttcttgagaaccttgtgatgtttccttatcctgaatttccccacgatttttttgcactcctggagcatcaaaatgaccaattacaaaagtaaaatcctctttcctttctgttttagtattaaatttaacggctgcaagcggtctggctcattctaatttaacacctttttggatcaaataaggatttgatggactggcaaaattagctatttctaaaagtgaagacttatataaaaatgtatatttttccttctgatttaccttgccctcttcggcagtggttatttctttccaagcggcattaggatttagcgtatttaattccttaacaatatcagatccatcgccggtctgcgttatctccgctaagccaactagatccagctttgtagagtttattacctgcgaaattgcatatgtttttgctgtatttgtttttgaggatttatttgaataatttaaaacatttcaaaagccaattcgaatagaattttttttatgatctggaactaaattagtattttctaaattacttgttgaatttaatttttcagtttgattaagggcagctgttgttgaatttgatttatttgttgatgtttgataaattaaataagctccgagtccggtggctaaagaacctaaaaagatggaggaaaaaagaaataattttttaattttcatatttacattaatactatttttttaatatttactagctaattcagttagattttcgtatactttttttaattcaagttcgtttaaaattttcactaataatggactaattttgatgtctaatttctggaaaatatcaaaatcaaaattagccttatcatttaatttaataaaatttttaaaaaataataactgttttattttttgattaatttgatttgcgattttttgattaattttatcaagatttaataaaatattatctaaatttttgtatttttctagtaattttatcgctgtttttttgcctaggccctcaattaccttaatattatcagaaacatcccctgctaaaaccttaaaatcaatcacttgagagggcgaaaaaccgtatgattcataaaaattttcctgtgtattaatatttatgaaattatttttaatttttgtaataactttagtttttttatcaactaattgtagtaaatcttgatctgcactaaatatgagtatttctgcttcattatcttttttctgaatctttttttttagcgatgctattagatcatcggcttcaaaatcttgatgttctgatcataaaaagttcgctaaactaagtatttttttaatttgatccatttgaaaaaaaagtgaatcaggaggttttattcgcccttttttataatccggatacatttgatggcgcggggttttcgcgccaaaatcaaaagcaaaataaacattatcaggtctaagaagctttaataatttaaaaacagaactaaaaaaaatatgaactgcaaaggtcatttccccttttgaattaataaggcgattaccatgaaatccaccaaaaaatgatttaaaggttaatcatgttccatcaattaataatatttttctagccatagttagcaattttttggacttccttttaaatagaatttgcctggttttgaaaaaaacactataaattcatagtgtttttttgtctcaagcaataaataatctgggtttttagtaaagattttgatctcattttcatcatcggctaaaatcaccataaaatattcgctattagcttttcttaatcttattacattttttagctctaaaattagccgatattcattcccaattcttaagtcttttagtctgatttgattagtgaataagtaattattttggtcatcaacaaacgacattccaagatattttacctcattttcataatttttttcttgattataaggaattttttctaaaaattctaaatccaaaccaaaattatctgttgtaagaactaaatttccgtctttatcattaagcacaaaactagcatgattccaaagtagctcaaaattatgagctaatgtctcctgattgccaaaatcgctaagagtatttgcaaaaatcaatttttcaattgccacttttgaaaaattgactaatttcattcttttaatgaaatctaaaaaatttttatatatcccattttttgatctttcatcaataattgttttaatcgcaatcgttccaaggcctttaaccattaaaagtggaagaaaaattgtgtttttccctttatcaaaaacagcattttctgttgaaaaattaatatttggcctatgaattttaaaaccaaaatttctcgcttcaccaacatattttttaatttttgcctgcgcgccgttttcatttgaaatcaactcaacaaaaaaataagcaggatacttggcttttaaataagccattttataagctaaagttgcataagctaccgcatgcgccttgttaaatccatagtcagaaaatttataaattaaattataaatatcttcaaccaatttaggttcatatcctaaattagtcccgtttttaatgaaattttccttaattttatctagttttgtctcatcttttttcgaaattgcaacccggattatatctgcttgttcgaggttaaaaccagctacaacctgacagatctgcataatttgttcttgataaataattacaccaaaagttgattcgacaattttatcatattcaggaaatattttctctcaattatttctctccttattttttgcataagtaggaatttgctgaattgggccaggacgaaaaagcgaaattatcgcaattatgtcattaattgaactaaccccaatttttttaatgcttgcggtcattcccggtgattctaattgaaaaatcccacttgttttcccttgggatagtaaattatttgttgaattttcactaattggtagctgattaaaagtgattttatgcccatctgaattaattttcgctagaatattagctactattgttaaatttttcagccctaataaatcaatttttagaagggaaaaatcctcaataaattctgcagcatactgaatttgatttaaattttccttagaattatgaacaggcactaattttgtaattggaatttttgataagactattccggctgcatgagttgaggactgtcgcggcattccttctaaaaaagcgctgattttatagatctttttataaatttcgctattattttcggccttaaaattatcacctttttcaattaatcttcgaaattctgaggatttttggtcatataattgggataaatttgcattgttcggaattaattttgcatttttgtttatttggatttcgggaattccaaaggtttttgaaatatcacgaaaaacacttttagctgctaaagtggaaaaagtaataattgtcgcgcaatggtcaggcccgtatttttcaaataaataatcaataacctcttgacgtcttgtatcctgaatgtcaatatcgatatcgggcatcgtaatccgttgcggatttagaaatctttcaaaaattaagtcgtattttaaagggtttacagaagtaatttcaagtagataggcgactaaagaacccgaagcagacccacgacctggcccaatcaggatttcatttttcctggcccattttagaaaatctcaaattatcagaaaataattagtaaattttagtttgcaaattgtttcatattcatattgcaaacgcgctttccatttataatttgacagttcaattctgcggttttgaaccgcttccttaaggattttttttaataaaagatcggattcaagtccatttttgtggtctaagtcaggaagattaaaatcaattttgggaaattgaatttgaatattttcgacaagataattggttcttttaatgataataggatcaatttcttgttctcatttattaaagtcaaaaaatttggtacttgaatctaaagttgtacctttaatttttgaaagtgcttcaaggtaaattttctcctctgcaaaaagtaaatttcgctcttgaagataaacagcattttcaattttaggattgttttcaacaatataataatttttaagttgattttcgccaaaaagtttgcctaattgttcttttttttgagcataaaacccttttttggggtgatcaactataattatatcatctttttctgcaagatctgttaaaaaaaggtcttttttttttgttttttttgaggaaaattccgaaagaataacatatcctgaataatttttggctagcaaaataaaattgaaattttcaatttcaatttcaagtccaattaccggatttatcttgttttgcttacataatttataaaattttggtaccccaaacattgaatttaaatccgttattaccaaagtttttaaattattttcaagcgcaaattttatcaaagagtctaatttgatcgttgatgataaaaatgtgtattcagttcttgtatgtaaattaattaattgcatatctttggttaaatattaaaagtaaaaaaagcgttttttatgtgctttttttacttttctttttgaatttcactaaatattttatcaattttttctactctttctacaactggatctagtaaaaaatggagttgtggaactttaaaaccttcaaggagattgccaaatttaagcctaataaatttttccgctttgataattttagctaaattttttctttgactaaactgaaactctaaataaacaaaaagatgggaattatctgctgaaagtcgaactcaattaacagaaaccggcatcctttctagaaaatatgtctcgattacttttgaaataatttgaaagtaataattttgttttttctcgtgactaacagacattctcttcctttttattcctcaatttcaacatctaaaaatgcttttagctcatcacctatttcaatatcattaaatttatagatatgagttccaaactcgttgccgacctgaacttcttttaccggatttttatctctttgtagggattcaatttttcctgaatggatcagttttgaatttcttcaaagctcaattttacaattttcgacaaattttcccgaaagtacactacatcctgcaattgatccgacttttgaaaatcagaatttagcaataatttttgctgtcccgatctgctgaagttcatatctaatctcacgcattccacggacttgttttttaatttcatcaacaattttataaataattgtatgttcgcgaatttcgacttgggcttgttttgcttgggctttaattgcagctggaatttgtaaattaaaggcataaattattgaatttgaagtttgggcaagtaaaatatctgccttatttacaatgccgacaccagagtgcaaaatgtgaatatgcacttgttttgatgcaagtttttcaattgttgaatgcaaagcctgggcaattccggcaacatcggccttgataattatatttagtgttttctcttttgtttgctgttttgtttgcacttttgtctttgaaattttctctgactgttttctttcaagagctaattgttttgcaaatttttcttcgtgaaatccgaaaaatttatccccggcttccgggacataattaagcccagtgacaattaccggagttcccgggggagcaaatttgattggctgaccattggtattttccagtgaacgaatccgaccatattgataaccagcaacgataaaatctctgaccattaaagtcccattttgaaccattaaagttgcaattgtccctttattatggtgcaattttgcctcaataactgtcccgattggatagcgatttttatttgcttttaattctaaaatttctgcaagtagtaaaattgaactaaaaagggtatctattccttgacccgttagtgccgatccatagacaaaaatgttacttccacctcattcttcggtgacaatattaagcgcagatagttcatttttgatcctatcaacatccttgtttggcttatccattttattaacaaaaacgattattggcacatttgcggctgcagcatggttaattgcttcttttgtctgaggcatcactccatcatcagcagcaacaactaagacgataatatcggtcacttttgccccgcgggcgcgcatttgtgtaaatgcttcatgaccaggagtatcaataaaattaataatatgaccttgaaaaacaacttgataagcaccagtatgctgggtaattccacctttttcattttttgcaatattagttttccggatataatcaagtaaggttgtctttccatggtcaacatgacccataactgtgatgattggcggacgggggctaagatctttgtcctgatcaagaattgaaacttcctccataaaattagaggcatcaatttggacttcttttttaaaatcaagcccaaattcaaggcatatttcggcaatttcgtcttcagaaagactatgatttaaattatacatttttgcctgatggaaaaaataagtaataatttgattcactgagacattaattttttgagctaattcagcaattgtcattattcctgaaaaaaggaagacgccgttatgaactttagtttcaacagtttttaattgtgctttaatttcgcttacatttgagattcgtttttgactttttttcatagaatttctacctcatttgctaaatttgtataggcaagagtggaaatatttgtcttaaatgcacgattaaaaagttttttttgaattgcttgttgaattttatcataatcagcaaaaatatatgcgcctctgccaccaatttttttatcaaaaaatttatcaattactaactttttatcaatataaacaaatcttattaattcacttactggataaattttttgatcaacaatacattttcttgtataatttttcacttttttatcctagaaatcaaaatcatcaatgtcaatatcgtcaacccctgtatattttagaagatcatcatctaatttgaaattttttatttgtttttcattttggatatataaatctgaattttggttaggttcttgactagctttttggatttgagcttcattttttgctcatttttccttctcttgtaataataattcttgttttttttcctcttcttggtgaattttatcgattaactcgttttcactaattgcctcatttagagccgaatcaaaaagtgaatctgcatcaaaaaaagatctttgactaatattttggaaagaattagaatctttctcgttttcaaagccataatcaaaatcttttgaaatattttcgcggatattctggcttttgttaaaattacgcgatttagttgctgcttttgctagattattcttgttttttggaaattcttggtgacttcttacctgtttttgctcattttttggtataaactcgttttcaatcccataaggtttttctaactcgcgaatatcagattcgaattgctgtaaaattaagtcaaaattattattaccttgaccatatgaattccgatgattttgataaattctaccctgctggcgatgaatatactcatttttaagactgtttagttcttgaatgtctttaatatttccatttcattcaattttaaaattttgatcttttagcgcgcttgaatacgggataatttgcacttgacaacgtgttagatctgctactagtttaacatttgaaccgttttttccaatggctaaactatgttgaaaatcaggaacaactacgataaaacgacgtaatttatgacctattttgaactcttttacgcaaataacttttgaaggcgacatcgcattaacaataaatttgacaatattatcatcatatttaatcacctcaattttttcaccctgaagctcttgagaaattgcaagaactcttgagccagttgctcctacaattgagccgatttcagaaatattatcagcttcggcatcctcatttctgcgaattgcgactttacatctttcccctggaatccgtgcaattgaagtgatttcaagaaattttgactgtagttcagggattgcatcgattatttttttcttgacaagttgaactgattttgaggatatcacaacctgcgactgttttgtattttttgatacattttcaattacaacttcatgtttagtgcctatttttaaattttgtccacttgcataatggcttggcataaaggcagaaactttatcatcgtcaatttcgaaaatataaccagcagcaattttattagtaacagtggccaaaactacgttatttttaagcgataaatatttgttataaacattatttcggacaatttcagaaattttttgcttaaaagcgtgcataattgccataaaaagtcaatgttcaaaactttcaagattaatttcaattgaaaaaatatcatcaacctgaatctcaggatcagtttcttttgcctttgatagtaaaataaaagaaacaagatcgttaactttttcctcatctgtaagatcatcaaaataattttcttcaacaacaatcccgtttgtattaaaaactttaaaactcaattgttcaagatcagcttcaatttttatttgcgcatctgggtcaattttctttgttattacaaattcaattgcttcctgaaaaatatcaataactgcttccagatttaattcgctattttttgccacatcttggatagcttgaattattaattttttactatcttttgaactaatttttgatttttcggttttttttctattcattttcgaaatcttgcccttttgaaagtacttctaaaataaaatttttctcatcggtctcaattttatcgataaaaatggaaatttcttttgaaatttcctcaacttgttttaaagaccgataatcagtgataattcgcaaataatttatcccgttttctagaacaaaattaattgataaaatttgcttaaatttacttgctaattgctcaattaagctcaaatctacctcttttattttaattttatttgtttttaattataatatattaaataaaaactaaaaggtcgtcaaaaagacaacctttttttaaatacaaaaatttttaaggttgaatatattataccactttttgattaacaaataaaaataaaaaatattttttaatgtcactataatatttattcttttatggtataataatattttttatataattagttttttatcgttagtaatacaatataataatgataacgatttttatgtaaatttgtaaattttaacattttctaggcttatattaatatgatttttaattataatactagtttattccgtaagaatttccgcggtgaatcatattgaggaccacttggtttaatttttaacggcaataattttgaattctacctttgatcacctaatgcaaatcgggtacattttgcaatttataaagatccggaagacaaaattccggctgaaattattgtgatgtcaaaaaataatgatgtttggttttgccaaattaatgcctcttttaatggatattcctataatttattaattgagcatcacgatttaaaaataactgaggcacttgatccttatgcctttagtattgcgccttttgattgaaaaaaaaatgaaagtccaaaagcatatttaattgacattttttccgaaaaaactggaaaaaatccttcaaaattagaaggatttaacaaaaatccgcaaattgatgctcaaatttatcagctgcacattcgagatttttcatctattagtaaaaaaacagaaaataaaggtacttttatcggagcgctagaaaatgatgtttttagttatttaaatagcttaaaatttaattttttacaattattaccaatccactcttgttataatttcagccaaaaaaacgctagcatcctccacaaaggggatggaaacggtcattttagcacttataattggggttatgacccaattggttacttttcgataaattcaagttattcaacagatccaatggatccatatctgcgaatttttgagtttaaaaaatttgttgactccgcccataaaaataagatcggaattgttcttgatgttgattttagtcacacctttaaaaattcaattcttgaggatgtagctcacgggcatttttaccgggatgaagcagctgttttacctgccggatttccgccacttgatacacgaaaaccaatggcatttaggctaattttggattccttaattttttttactaaatattataaagttgatggatttcgctttaatttagcatcttttttagataaaaaagcaattacagttattgccagtgaactaaaaaaagttaatccaaatattcttttatatggtgatttttcaaattttagtgacctaccaagcagaaatcgacttgaaaaagggaaaacaggaaatagttttaactttggatatttaaacgatacaatccaaacagcaattatcgggagcggaaatccgcgtgataaaggtttaattttatcaaaaactagtaaaaaattcgctgcttatgtttcttcaattccggggaacattgcaaattttgacttccaaaatttgccatattcaaaaaaaaaatacgacctttttgcaaacgatatcagcctaaatcttgcctatcttacttgttataatggcccgactttagccgataaaattcttagtgcgacaacgcgaattggaaaaagagaatttcttgaaatctaccggcaagccttaatgatggtcaattttgtccaaggaaaaatttcacttagtgctgggactgaatttgctttttcaagaatttgtgatttttctgggggcagttatcaaaattgctatcctaatttaaacataaaaagaccgcctttttcgtttttagcgggcaaatatcttgattttcattctgataaaaccacagatttcacaaatggattgaattttgaaattcttaaaaacaatgaaatcaaagagaaaatctttgattttcttgccgaaattaatcaatttcgccaaaattctccattttttcggcttgatacaaaccaaaaaatcaaaaaacagctaaaatttgaaactgttgataacaataaaggattaattatctttaaaattactgctaaaaataaagtgattaaagttattcataatttttcacatctttcttatgaatatgattttaaaaattttaatattctttttagctcaaagattaaagttattcctaatttaattcagaaacatcagtcgattttattaattaaaaatagctaaattagacaaaaaatttttatttaaattttctggttaatttgaaaaatactttaattcatagataaatttaaatattatatctattttagccagaattaatttagatatattcaatagtttccactaattcggtttttttaaccaaatcaatccgattttttacaaaattgactatttcaagagcaattgctggggaagctgacaaaccaggggactgcattccggctgcaaaaataaaatttgggtcattaaaagctggtttaatcacaaagtcacttttctcagcttcgattggtcgggaacctgctaaagcaaaaaccgtttctgaataatcaaggctaggaattattttatgaccaattttttgaatttcttcattcagatcaaaatcaaggcaatttaccttatttttcgatatattttctttagctgttggcccaactaagatgtttccgtctggccgaggcgcaacaattactccttttccgtattttgaagggactaaaaaataaatattttttatattggggtgattttttaaaattaaatattgaccgcgcctttgtttttgactaaattcgccaaaaccggctatttttccgatttcatcggcataatgaccggcggcatttattataatttttgactgaaaaaaaggattattttggttttctgttttaattaggaaaaaattttgactatttttagaaattgaaataacttttgaactactaaaaaattctaaaccatttttcctagaaatttccaaaaaagcatacgcggccttaactggatctaccacccaggaattcaagcactcaagcgctaagactgcttcttctgatacatctggatgcgctaatttaagttcttttttgcttaaaatcgataagtttttagggtcaagaccgttaataattcctcgtttataaagatcgtaaattattttttcttcttcagagtcaaatgccaaaactacgcttttggctttttgacgcggaaaaataatttttttaaaaatattttcagtccataatttatggcctaaaacattgaattttgcttttaattttcctggacttggatcaaaaccacaatgaattatccctgaatttcctgttgttgtctcagatgctgggtatttttttgcttctaaaagtgcaattttaagctcaaatttactaagttcataagcaatattagttccaataattcccgaaccaataataattacatcgtaatttatattatttttttctgtcataatgtaattcttcccctaaaaacagttatataatataaattataactaaaatttttgattttaatgtttttttgttcttttattgattaaatttaattgggctttttgcacaatttttttcttaattattaacgaaggaataattaagaaaattgataaaaaaaccaaaaaaacacgtaaaatcacgagactttttgaatcatttaaaggatatgttacaagcaaaatgctcaacgaaaaaaggattatcggataataaaaaataaaggaaaaattaacaatttttaatcttatccaaataaatgatatcagaaaacataaaaaaaaatttaaaattgttattagaagcaaaattcagaaggaaattatagtttttccataaaaatcaggcgaaaaaaatgcataaataaggctaatcggaagaattattgtaagcaatgcaaataaaaaatcaggaattttcgttatttttttatacatttttttcgctgtttttcaacaaatcgacaaaatcaactagggaaattctaaataattcaggagaaccaaattttctataggtaatttcattttttgtaatttcctcatccccgattattacctgaaaatttattttttctaaatttgcctcgcggattttgcgcgaaatgcgctcagatctgagatcaatttccgaattaaatccaagatcaaaaagaattttatgaattttttgggcaaaatcattatgtttttcagctactggaataacaattatctgttttggcgagattcagaaaggtaaatttcccttgctttgttctaataaaagcgctataaaccgttcataagtgcctattaaaccgcggtgaattaaaattggagtttcttttttattatactcatttataaaggaaattttaaatttttcaggtaaaaggaaatcaagttgtaaagttgaaattgttaactctttatttagtgcagttttaacttggaagtcaattttgggaccataaaaagcagcttcaccgattttttctatataattaattttattttgatctaaaaactgctttaaatcagcttctgcctgttcccacatttgatcatcttgaaaaaatttatccttgtttttagggtctctttttgaaaatgagatataaaaaatttggaccttaaaaaaatcaagtacctcagaaatcatttgaaaaagatgactaatttcactaaaaatttgacttttactaacaaaaatatgcccttctgttaaatccatagctcgaacgcgttcaaggcctaaaagtgctcctgatttttcataacgatataatcgtgattgttcagagattcgatatggtaaatttcgataactaaaaagttgctgtgaaaaaaggataatatgatgtgggcaagtcatcggacgcggaattagctcctcgttttcaatttttaagcctttaaacatatcatcgcgataatgtaataaatgtccggaaattttatataattccttatggccaaaatggggcgtaagaacctctttaaatccgtaattacggtcaaattcaagaattttttggcgaattttattataaattcgcattccattttcaagtcaaactggaaaaccatggccaaaataagaactaaatgtaaacagttttaattttgccccgatttttcgatgatctctttcttgtctttcttgtaaaattccaagaaatttatcaagattttcttttgaatctcaactagttccataaattcgggttaactgtttgtttttagaatcaccttttcaataagcgccggcaatttttaaaagtttaaaattttgaatttttcctagagattcaagatgatttccataacataagtcttcaaaaagtatgttgtttttactatcaactattgaaaaataagtgattttttcaccttttttttctaggtcattttttaattccgctttataaatttgattttgaaaatcaaggttcttcccatcggtttcaacaatctttagattttttgaaaccaactttttcattaatttctcaatttttggaaaatcagattgcgaaattgagactgaaagatcaaaatcataataaaaaccatcatcaaaaacagggccaattccaaattttacacccggataaagaattttaattgctaatgctaagaggtgtgaacttgaatgatttaatttatagtcaatttttaagtccataaattataatcctattttttctttgattttttcaaagttagaaacagcaacttcttttgcttttttagcgcctttttttgcataaatctcgactaaatcgagatttttttgatatttttcttgtaaatctcttaaaaattcagcaactattatcccaactttttgttttaaaaactggtaagattttccctcaaaaaacgcctgagtttcatcaactggtattccagtaagtcccataaaaatgtttaaaagattggcaactccaggttttgcaaaattaaaattaacttcattataagaatctgtttgtgctttttgaattttttgatatgcctcatcaggactgtctgttaaaaaaatagtcgaattttttgattgagtagatttggacatctttttttctggatcagttagcgacataattttctgtgttctttcagaaattattgttcttggaattttaaagtcggttttataaattttattaaatctttgggcaattttccgcactaattcaagatgttgcaactgatcagcaccaactgttacaaaatctgggttatacaaaagaatatctgcagccatcaaaattggataagttaaaagtccggtgggaattttttcagtattattatcctgttttaaacgcgctttgtctttgaattgggtcattctcgaaagttcaccaattgtagtttcagactgtaaaagtcaaaataattcagaatgttggctaatttcagattgaaaaaaaagcactgttttttctggatcaaatccgcatgcaagataaaaagcaaaaatacttttacggttttcagctaattcttttggatcaattggcaaagtaagcgcgtgaaggtcagcaacgaaaataaaattttcgtattcattttgcagatcaagactaggttttatcgatcctaaataattcccaagcgttaattttcctgttgccgtaatgccagtaaccaatctttttttcataattaaaaaattttaacataatttatataaaaagttttaaaaataagtataatttaaaacataattatgaaattagtttctaaaatcatttatttttttctacaaatttttacttttggtttatttgcaaaatatcttaaaaaaaaacataataaaaagaattctgatttcacttatgaacaaaattttgactttaaaattgaggttttaattaacttgttaggcgggaggtcaaatattaaaaaaagtgattttaatatttcccgattaagaattaaactaagatcaacagaaaatcttgattttgaaaaaataaagaaattaaaggggatttcaggtatttttgttagctcagatacaataactttgatagttggtaataaatctaaagcaatttcagaagcaataaataattttggataagtttagaaatgtttaaaaaatcctaaggaaattacagtgaaaatacaaaaatttggaactcaaaaccgtgaaaatcaaaaactaaataatacaaaccaaaatttaagttatgaacgtttgcttgcaaacttaattacagtcgaaagggctgattctgcactttttactagaattgataatgaaaattatatcgatttatatggcgctttaaaattaagtgattttaaaaaattaattaattcaccgatctcatcagtatcacttgcatcaaatgaatttgatgattttagtgaaaaaatcgagtcaataaatacaaaggatgaactagttgaatttctaaaaagttcagattataagctaaatccgcttttattaagatcgttaaatactgattttgaaggtggaaaaaaggaaattttaagtaaaatttcttataaaaaacaaacaagcctagcaaaatggaagcgactaattaagaaagcttatgatattttaagggacagaaatatatggccagtccatatcggttttggatatatttcgcttacaattgaagatagaagtttttttggtcctttatttgtcaaggaatgtgaagttactattgtaaactcagtaccaagactaaacgctgatggacatataaaattgaacgctaaattgcttacttttttaagaaagctcgatatagattttaattttgactttgatttttccgaattttcaattacggaattaatggaaaatgtaaaaaaattctataatgataaatttgaaatcccaagtattgaaggtaaaattcctaaggaatttgcaacaagtgaagatagtataaattttcatcctggtgccgttttaggattttttaacattggtggctcacaccaacgaagcattatggaaaaaatgataaaaacaggcgaaattcacaacctaattgaagttgatattaataaaactggttatcggacagcaattgaaaaatcaatattttcacctaaatttacaggattttttaaaatccaaccaactaatttcacacaggattatgcccatatttcagcaattttgcaaaatacaattatctgaggccccccaggaaccggaaaatcacagacaattgcaaatataatttctaatattatcgcgctaaataggacagctcttgttagttcacagaaaaaaattgcgcttgttgtcctaagaaaaagactgaaaatgatgtcatttttctgcctttttgtcattaatgaaaaacttgaaaactataaggatttttataaaccaattgaagaatatattgaaattattgaaaatttcaatatggaatccaaaattgatgaaatcaaagttttctctgatgatgatcggaaatatttagaacttttagctaacattttcccaaaaactgacattctcagaaacactttagaggcttataaaataattgaaacagccaataattttttcgcccttaatgttgctgaagcaatttttaaactaaataaatcaataaaaattaatccaaaaagatcgccaagaacagaaactaaactaaaattgcatattgtcgaaactcaacttaaaagaaaactaaaaatttatgaaaaagcacttcatagtgtttcaaaagatttacgggaagatgtaaatttaattcttgaaaatttagcaaattatgatgataatctagaaaatatttataataaaatttcaaaattggaaatttccaattttgaaaaccttgaaaaattcctgaatttttcaagaaaaccaaaagttgaagttcttgatgataaagctttatttatttttcatgcaaaaaaagtatttgaaatccttgctaaattaaataatgataatgaattccaacaactttatactcgttttcgtttaagtgtaaagcagaaaaagaaaatgtcaccttataaatttttactaaaacattctgaaattattaaggttttatttccggtaattattacaacccctgacattgaacttataatgtttgagaaaaaatattttgattatgtaataatcgatgaggcttcgcaaatgttccttgaggaagctttgcctcttttattttatggaaaaataaaagttttagttggtgatcaccaacaaatgcagccgattcgttgatttgcctctaaaataaatgaagaatctgaagatgatgcctttgcaaatattgaatcaatcctagaatatgcccattctaaaggtgtttttaatattatgttagataaaaattatcgctcacatcatgcttccctgatgacttttaactcacgccatttttatgaatcagaactaaaaattgcaaataattacaaatttgaaggcactgatgtaattgaagttcaaaatgtaaatggccaatgagatggacaacaaaatcttgttgaagccaaagccgttgtcgaaattgcccagaaaaatattaacaaatttccaacaatgatcattctggcctttaataaaaatcagcaaaatgcaattgaaagaatcatttttgaatcctaccctgaaattgaaaaattaatttatactgataaaattatcgttaatagtcttgaaaatattcaaggagatgaggcagatttagtaataatttcagttgcatatgaccaaagtgcgaaattcgtttctacttatattgcaagaaaaggtggaaaaaacgccctaaatgtagctacttctcgcgcaagacaaaaaatgataatttgcaaatcaataaatgctgatgaaattcagaatacttcaaattctgaagatcttgaaatttttaaagaatgaattaactttttagaccttgatatccaatcacaaattcattattcacgcaagaaaaagacagaactctcacttgctgaattacaaaatgtgcaaaaatctagattttttactgattttcaacaggaatttattgaagaatttagcaaaaatttccctgattttgaaacaaaaacaaattttgctatcggtagcgaggaaattgatgtagctatttttgatcagagtcaacttttatttgcagtctaccttgattctttagaatacaaagacccaaaagaatatattaaatattttgatgctatcaagtttattgaagaaaaaaaataccctgttttcattcttaattttgttgaatggaagctaaataagcaaaaaataatgaccaaaattaaagaaaaaattcttactttgaaagaagatgatcttgtctaaaaaccaattatatgctctagatgacttagttattggttgtgatgaagttggagttggtgaatattttacaaatttaactgtatgttgtgcagtttttcgtgaaaaagagattaaaaatgaacttttaatacaaatagttgattcaaaacttttaacagaaaaaaaaatttctgatctttttcaggttataaacatagaccaaaaaataaaacataaatttaccagtcttgaaatgaatgagtataataaacttattgaagatggactaaattcacatcaaattaagtcacttttgtattttcgagttttaaatgatttgattttgaatcttgaaaatgaaaaaattaataaaatttttattgatggatttgtaagtgaaaaaaagtttaaggaatattttgcaaaaatagcggaatttttaaaaattgaaccttgagattttcaaaaattcccacttatcttagaaaaaaaagctgatacaaaaattaagcaagtaggcgcagcctcaataattgcaaaatttgctttaagtcaaaaatttgctaaaaggcaagagaaatgaaaggctgtttttcctgctggttccaatcagattgaaaaaattgttaatttttgtgttggtcaaattgaaaaatatggcaaaatttttcttgaagaaaatgttaaacttcattttagtatcactgaaaaaatttatgcaaagttagaggaaaaaaatgggaaaaataattaaattattcgctgaaagcactgaaaaaatcgccacaaatatcaatgttgctggcggagttggtcttggtggctgaatcggaattacaatttcggttggaattattctttttattgttggtggaatcattgctcttgttgtttcaaaaaaaatgtttgaaaaacaaataagagaaaatcctccaataaccgaaaatatgatcagggcaatgtatatgcaaatgggtagaaaaccatcagaagcccaaattagagcagtaatgcgctctgtcaaaaatgcaaaaaaataggaaaaatgtgaaaaaaaaattagttttaattattattgacggacttggattgcgccttgaatcccaaggaaatggttttgcactggcaaaaacacctgtttttgatagactttttcaagaatatccaaatagtttaattgctgcttctggtcaagaagtcggacttcctgaaggtcagatgggcaatagcgaagtcggtcatttaaatattggcgctggttttgttgtctatacaggtatttcaattataaataatgctttaaaaacaggtaagttttttgaaaatgaaaaatttattttagcctttaggcatagtatcaaaactggatttccgctgcaaattatgggtcttttttcacctggaggggtccattcccaccaagatcatctttttgccctgattgattttgccgctaattttggggttaaaaaactaaatcttcacctttttggtgatgggcgtgatgttggcccaaagtcaattaagccctgaattaaaatgttaaatttaaaattaaaaaattatgaagattataaaatagcttcaatttctggccgtttttattcaatggaccgcgataaaatgtttgaccgtgtcgaattaggttataatgcacttttaggaaaagcagaaaataccttcactgatccaattgattatatcaactttcaatatgaaaaaggggtaagtgatgaattttttgaacctgcaattaacctcaaagtcaacaagaaagattttttagctgatgatcatccagtgatttttttcaactttcgacctgatcgagcaaggcagctaagccacttaattttacagactgatttatatgaacaaaagccaaaaaatcctataaaaaccgatgtttttgtttcaatgatgaaatatgaaggcataaattgcctagtcgcctttgaagaaatgagagtcgaaaatcctttgggaaaattaatttcaatggctggatttaggcagcttcgactagctgagacacaaaaatatgcccatgtcactttttttgttgacggaggtgttgaacttgaactagaaaattcagatagaattttaattgattcactaaaagtgcaatcatatgctgattttccacagatgtcagctgttgaaattactgataaacttcttgaagttgggcaaaattatgattttatcatcatgaattttgcaaatccggatatggttggtcataccggagatttgaaagcaactattaaggctgttgaaattcttgattttcaaattggtagaatttgcaaatgggcagaagaaaaaaattttgactttttcattaccgctgatcatggaaatgctgaattaacagaggatgaaaacggaaatccgtcaacaaaacacacaacttttccggttatgttaatttcaagtgataaaaccatcaaactaaaaagcggaaaattagcaaatattgcaccaaccattttggactatttaggacttgacaaacaccctgatatggaccatgattctttgattattaaagacaaataatttttctttatttgaaaaagtgtcctaatttatagtattttttaaaatccaccaaaaatttattttttctttttctttttttttttttttttttgataaagttacattataaaaacgtattatctacttagataaaatactaaaaaattggagtaaacaaaaagatgaaaaaaagtaagaaaaatttatttaaaaaaataatcaaaatttctctttttggtattttttcaactttatttgtaatttcttctactaatgacaatctacaaattcaatctgttattagtagaagaaatacggaaaattgaagtgaaaagtctcaaaacacatataaagttagtcaaatggcttctgttaataacgttgacgaagatgaaatttcaaaagcaattctaaaaatcaaaccaagagaagatgagtttgtcccagcaatcccacttttatttggggcgcttggtggaattctatttggcgggttattttcaagttgacttagccaaaatccactacccgaattacctcgattgggcaatgttggctcatatgccccacaaattgaccaaaaaccaagtcaaaatactgagaaaaaagtatcaaaaaggtatgaaaataattcataccaaagttcttttcttgattatttccaaaaaactgaaaaaaaatctaaaattgataattctggacctgtatatgggccatttttgcctggcgaagataagcgcgaactcgacccaattgttgcaaaaagtgctaattcaataacaattgatcttaatattttatcgataataactaaaacaaaattatcagagagagttgcagccttaagcagagtcgaatttgtcgaaattactgatagaaaaaaattaaaagattataaagatattcatcttgcatacttttttgacgaagttccaggtggaaaaccaaaatttataattagcaaaactaaaattagtgaaccggttgcttgggagctttcaattttaggtctgcaaattgaattaggaattccagaaattttagaaaaaaatttcttcccaaatattcgattacaaccattagatttaatagaaaaatttctgaaaagactaatgtttagacctaatttttattcttataataaacataaaatgcagcaattagcctacaaaattgccgccacaatcaacacaataaattatggaaatttaggatataatgttccatatttaaataatgataatgatccaaattatcccaaaagttattatattgttgaagatttttatgaagaaatatttgataaaaacgaaaattgatacataaatatgccatcgggggaaacgtgatatttggatggaaaggaagaagacccagtcgagagagaaaaccagagaaaaaaaatagcgaaaaaaagtattttttttaaaaattaccatgttagacgatataaattgcatcctaataataagaaagatagagtttgagaaccaaacctaaaaaaagttgaaggaattcactatttatatggagacccagtcaaattcccttattaaaattaaagaaaaattcctagaaaatagatatcgagaagtaaatatccgagattttttttcaacaagaaacatttatatgcactggaaagaaccttatatttgggttaatggagagaaaaaatttaactgtttttctatttcgtgttattgtgatgataaatttgatccttttttggagattaacggcattccatcatataaaaatacccgcaatccaattgaggatatgatcgcaattccttataaacaaggcgattatatttatcgacttcgtctggatgaaatccaaaaagctacttttttttcaaaagaattaagattttttaaattttataaaaaatcaatttctaaagagatttataaaataatcagcgagagatatcatcgggtttcaaaatctcgttgaaatcttgatggtattttttgagataataactcctgaaatgatataaaaatggtggtagttgcaattgaaaatatcgaagatgctcagaattgtcaatattcaatttcttttccttcaatttttagaatgagttatacaaataaaacaaggcttaaagaagtcgagcaactaataatcaatgaaattgaagaattaattccgtatgcgaaaccgaaaaatcttgaaaatcacagagaaaaaatttttgattttttgtcaatccaaaatgagtataattccaaatattttgatccagataagatgtatttaggtgttaaaattgagggtgatttaaaaaagatcgaaaaagaattccaagattttgaagctaattacccacttgtatttaatgtaaaaactttagaaacttatgaaaaaattttagaaaaatttaaaaaatacaatattaagaaatttgatcttgaaaaagacgacagaaatcaaattttaattagttggcttgacaaatttgggccggaatatcaaaaacattgtattaatctattcggaaaagatggtgaaaaatattatgatgaacttgaaaaatggacaaataaaataaatctaatccaaattttccaaattatgtttggacctttaatctattttatatgaacatataaaacatcacacaccctcaaaccagatgctgttattttaaaaagttggggttgtcttaatccttcaaaatttgaattatattattttggaggtcccgaatatggaatttatgatgaaattctagaaaaatttgactcaaaatatcctgttttctgagtaaataccgcgtatgaaccgagtggtcatagctcaacaaatggctgaattcccgatattattacaaaaaatttaattttaattcaccgggatggcgacaatgttttatactgaattggaaaatcaccattttatcatcatgtttataatgggaaatattttccattaaatttatattataacaaaaaaatttctgatattgaaagagatatttttttgcgcgaaaacaaagatccggaattttattcatatgattataatttatatattgatgtaattagaagatcaaattctgaattaagtcaattatttgattatattaatttatatgaaaaaaaatataaaaaagataatccaggtaaaagttttcaagattttttgcataaatctgatttgcttactaaaagtgcaagaagaagattatcaaaatttgagctaacaacattttataaggtttatgaaaaaacagttaattatattgactttgataaaaatgaatattatgattttaggttaaacgcaatttataaaaaataacggtaattattatgtttttttaatttataagatttaatttatctaatttttcctaattcagactaaaaatataagcaataaaacaattaatacaagcctaaaatttataaaaattttgttttttctgataaaatttaggtattacaactagttttttgctataaaaattagtcaaaaaaagactaagaaggaggacggttatgaataaaaaaagtaaaaatttacttaaaaaagtctgcaaaatgttctcttttgcagcattttcaactttaataataacttcttatagtaataataatttccaagataaaactccgtctagccaaaaaataacagaaaatttaagcaaaaaatcccaagaagtcaataaaatcagccaaatggcggccgttaatgaactagaagatgaagaaatttcaaaagcaattttggaaattaaacctagagaagatgagtttgccccagcaatcccacttttatttggggcgcttggcggaattctatttggcggggtattttcaagttgacttggccaaaatccactacccgaattacctcgattgggcaatgttggctcatatgccccacaaattgaccaaaaaccaagtcaaaatactgagaaaaaagtatcaaaaaggtatgaaaataattcataccaaagttcttttcttgattatttccaaaaaactgaaaaaaaatctaaaattgagaattctggacctgtatatgggccatttttaccgggcgaagataagcgcgaactcgacccaattgttgcaaaaagtgctaattcaataacaattgatcttaatattttatcgataataaccaaaacaaaattatcagagagagttgcagccttaagcagagtcgaattcgtcgaaattactgataggaaaaaattaaaagattataaagatattcatcttgcatacttttttgacgaagttccaggtggaaaaccaaaatttataattagcaaaactaaaattagtgaaccgattgcttgagagctttcaattttaggtctacaaattgaattaggaattccagaaattttagaaaaaaatttcttcccaaatattcgattacaaccattaaatttaatagaaaaatttttgaaaagattaatgtttagacctaatttttattcttatagtaaacataaaatgcagcaattagcatacaaaattgccgccacaatcaacacaataaatggagcaaatttaggatacaatattccatatttaaacaatgataatgatccaaattatccaaaaagttattatattgttgaagatttttatgaagaaatatttgataaaaatgaaaattgatatataaatatgccatcaagtgaaacatattatttagaaaacccaaaaatagacccaaatagaactaaaaatatctgaaagaaattagaaaaaaagtctattttttttaaaaactaccatgttagaagggttaaattcaaaccaagtgatagagaaaaaaatgaaaaaacgggaaaggatataagacatagcgacctaaaaaaaatagaaggaattcattatttatatggagatccagttaaattcccttattaaaattaaggaaaaatttatcgaaaatagatatcgcgaggtgattccgcgcgattttatttcaacaagaaatatctacatgcactgaaaagtgccacctatttcggaaatcaatggtgaaaaaatagttgactgttggcctcctttaccttattgtgatattaaatttatgccatttttagaatttaacaattcttcctcaagtttgggattgcacaatccaattgaagatatgattgcaattccttacaaacaaggcgattatgtttatcgatttcggcttgatgaaatccaaaaagctacttttttttcaaaagaattaagattttttaaattttataaaaaatcaatttctaaagagatttataaaataatcagcgagagatatcatcgggtttcaaaatctcgttgaaatcttgatggtattttttgagataataactcctgaaatgatataaaaatggtggtagttgcaattgaaaatatcgaggatgctcaaaattgtcaatattcaatctcttttccgtcaatttttagaatgagttatacaaataaaacaaggcttaaagaagtcgagcaactaataatcaatgaaattgaagaactaattccacatgcaaaaccgaaaaatcttgaaaatcatagagaaaaaatttttgattttttatcaattcaaaatgaatataattccaaatattttgatccaaataaggtgtatttaggtgctaaaattgaggatgatttaaaaaaaatcgaaaaagaattccaagattttgaagctaattacccacttgtatttaatgtaaaaactttagaaacttatgaaaaaattttagaaaaatttgaaaaatacaatattaagaaatttaatcttgaaaaagatgacagaagtaaaattttaattagttggcttgacaaatttggacttgattacaaaaaacattgtattaatctattcggtaaagaaggggaaaaatattatgatgaaatcgaaaaatgaactcataaaataaatctagtccaaattttccaaattatgtttggacctttaatagattttgtttgaacgcgctcaaattattacataaccaaacctgatgccatcattttaaaaagttgaggttcgcttgatccttcaaaatttgaattatattattttggcggtgtggaatatggaatttataatgaaattttagaacaatttgactcaaaacatcctgttttctgattgaatactggttatgaaccaagtggaagaaccggcacaaatggctgaattcccgatattattactaaaaatttaattttaatttaccgtgatggggaaaatattttatactgaattggaaaatcaccattttatcatcatgtctataatggaaaatattttccgctaaatttatattataacaaaaaaatttctgatattgaaagagatatttttttgcggcaaaacaaagatccagaattttattcatataaatatgatttaaatatcgatgtaattagaagaaccaacgagcagttaagcaaattgtttgattatattaatttatatgaaaaaaattataaaaaaaataatttaaatgaacattttgaaaatttcttacacaaatcggacttattaactaaaagcgcaaggagaaaattatcagcatttgaaagaacatcgttttttactaaacacaagaaaactgttaattacattaatcccgaaaaaaacgaatattatgattttagattcaatgcgctttataaaaaataactgtaattattagtttttattattattaaaaaaatcgtgttgctaaatttttgttatttttgatgcttttttggtttaaaaagaggggtaaaaaggttatcagaaactaaaatcgtaatacgattacatttaaacacgccaaaattaactctcaaaaacgtgttttttagttttaaaaagaatcaaacctaaaaaaagttgaaggaattcgctatttatatggagaaccagtcaaattctcttattaaaattaaggaaacatttttagaaaatagatatcgagaagtaaaggtccgcgattttatctcgacaagaaatatctacatgcattgaagagaaccttatatttgagaggtgaacggaaataaggaattgcgttgtcttccttattattgtcagcgtgaatttattccttttttagactttgctgccactagttcctacaaagacggccacaatccaattgaagatatgatcgcaattccttataaacaaggcaattatatttatcgacttcgacttgatgaaatccaaaaagctacttttttttcaaaggaattaagattttttaaattttataagaaatcaatttctaaagaaatttataaaataatttatgaaagatatcatcgcgtggcgaaatctcgttggaatcttgatggaattttgtgggataataactcatgaaatgatataaaaatggtggtagttgcaattgaaaatatcgaagatgctaaaaattgtcaatattcaatctcttttccgtcaatttttagaatgagttatactgataaaataagactaaaagcggccgaacaattaataattgatgaaattgaagaactaattccgtatgcgaagccgaaagatcttgaaaatcacagagaaaaaatttttgattttttgacaattcaaaatgagtataattctaaatattttgatccaaataaggtgtatttaggtgctgaaattgaggaagatttaaaaaaaatcaaaaaagaattccaagattttgaagctaattacccacttgtatttaatgtaaaaactttagaaacttatgaaaaaattttagaaaaatttgaaaaatacaatattaagaaatttaatcttaaaaaagatgacagaagtaaaattttaattagctggcttgacaaatttgggccggaatatcaaaaacattgtattaatctattcggtaaagaaggggaaaaatattatgatgaaatcgaaaaatgaactcataaaataaatcttatccaactttttcaaattatgtttgggcctttaatcaattccatttgggaactttttaaatctcgtatgattaaaccagatgctattattttaaaaagttgggctacacttgatccttcaaaatttgaattatattattttggaggccccgaatatggaatttatgatgaaattttaggaaagtttggttcaaaaaatcctgttttttgattcgcaaccgcatattatccaagtgatcaaagcgcaatgaatggctgaattcccgatattattattaaaaatttaattttaattcaccgtgatggggaaaatattttatactgaattggaaaaagtccattttaccatcatgtctataatggaaaatatttcccactaaatttgtattataataaaaaaatttctgatattgaaagagatatttttttgcggcaaaacaaagatccaaaattttattcatatgataatttatatattgatgtaattagaagatcgaattctgaattaagtcaattatttgattatattaatttatatgaaaaaaaatataaaaaggataatccaaagggaagttttcaaaattttttacgtgaatctggttttttagctaaaagtgcaagaagaaaattatcaaaatttgaactaacaacattttataaggtttatgaaaaaacagttaattatattgactttgataaaaatgagtattatgattttagattaaacgcaatttatgaaaaataactgtaattattatgtttttttaatttataagatttaatttatctaatttttcctaattcagactaaaaatataagcaataaaacaactaatacaagcctagaaatttataaaatttcattttttgtgataaaatttaggtattacaactagttttttgctataaaaataagtcaagaaaagcctaagatggagtgtgatgaataaaaaaagtaaaaatttacttaaaaaagtttgcaaaatatttctttttgcagcattttcaactttgataataacttcttatactaacaatagtttccaagataaaacttcgtctagccaaaaaataacagaaaatttaagcaaaaaatcccaagaaatcaataaaatcagccaaatggcggccgttaatgaactagaagatgaagaaatttcaaaagcaattttggaaattaaacctagagaagacggttttttacctgccattcctcttttgctaggtggttttggtggaattttgtttagcggattatttgcaaattgatttagccaaaacccactaccagaattgccacgaattggtggtcaccaatcatattcacctcaatttactgaaacatcaagcgaaaacaacaagaagcaaccattaccaaaaaaaccagaaaaaacttttgaaaataatccttgatttggcccaacaaaaatttctaaaaatcaaaaattaattcctaataattgactacaaaatgatcaaaattctagtgaaaatcaaaattggctatctgcattttcaaacccaaaatccgaaaaacaccaaaaatctggtccagtatacggtccttttttaccaggtcaagacaaacgggaactaaatccgattataacaaggacgcctaattcagttactattgatttaaatattttggcaataaaaactaaaactaaattatcagataaagttgcaactttaagtagagttaaatttgttgaaataacaaacaaggacgaactaaaaaagtataacgatattcatcttgcttattttttcccaggtattggaaattataaagcaaaatttataattagtgaaacaaaaattagccagcaagcagcttgggcactttcagtttttagtctccaggaaagcatgggccttccaataattttagaagaaatttttttcccgaatttagagtcaaattcatcaattgtagtcgataaagttaaaagattattgagttttaagtctgatttttattcatatagcaaaacaaaaatgcaacaattggcttacaaagttgcatcgacaattaacataataattggtgctaaatttgcttataatgtcccatatttaaatgatgataatgatgaaaattacccaaaaggttaccttgttaaggaaaattttattgataaaccttttgatatggaagaaaattgataccaaaatatgccatcagatgaaacatggtatttaaatgggaaggggataataaaaaaaagagaggaagagattaaaaaaaggttgaagaaaaagaaatttttttcaaaaattatcatgttagacgagcaaggcttcatccaaaaattaaagatgaaaaagcactaaaaggtgaaaaaatcaaatttgaaaaactaaaaagagtagaaggaattcactatttatatggagaaccagttaaattcccttattaaaattaaggaaaaatttattgaaaacagatatcgagaagtaaatgctcgcaatattctttcgacacgaaatatttatatgcattgaagggaaccttcaaattcagctaatggccttaaggatttccggtctcaatgcagacttacatattgccatcaagaatttatatcttttttaatttttaatgctacagagtcagataaaattggccacaatccaatcgaagatatgattgcaattccttacaaacaaggcgattatgtttatcgacttcggcttgatgaaatccaaaaagcaacctttttttcaaaagaattaagattttttaaattttataaaaaatcaatttctaaggaaatttataaaataatttatgaaagatatcatcgggttgcaaggtcatgttgaaatcttgatggaattttttgggataataactcttggaatgacataaaaatggttgtaattgcagttgaaaatattgaagatattgaaaattgtcaatattcgatttcttttccttcaatttttagaatgagttatacaaataaagcaagacttaaagaggtagagcaactaataattgatgaaatcgaagaactaattccatatgcaaaaccgaaaaatcttgaaaatcatagagaaaaaatttttgattttttatcaatccaaaatgagtataattcgaaatattttgatccaaataaggtgtatttaggtcctgaaattgaggatgatttaaaaaaaattgagaaagaatttcaggattttgaagcagattatcgccttgcatttaatgtaaaaactttagaaacctatgaaaatattcaaaaaaagtttaaaaaatatggaattaaaaaatttgacctggaaaaagacgatagaagtaaaattttagttagttgacttgacaaatttagtaaggaatacaaaaagcattgcatcaatttattcggaaaagaaggcaaaaaatattatgatgaaattgaaaaatgaactaataaaatagatcttattaaactttttcaaataatgtttgggccaataatcaattttgttggagcttattcaaactattacatagcaaaaccggatacaataattttaaaaagttgagcatcgcttgacccttcaaaatttgaattatattattttggtggaccagaatatggaatttatgatgaaattgtgagtcaatttgattcaaaaaatcctgttttttgagtaaataccgcgtatgaaccaagtggttatagcgacacaaatggctgaattcctgatattgttattaaaaatttaattttaattcaccgtgatggggaaaatattttatattgaattggaaaaagtccattttatcatcatgtttataatggaaaatatttcccactaaatttgtattataataaaaaaatttctgatattgaaagagatatttttttgcgcaaaaatagagatccaaagttttactgatataaatatgatttaaatattgatgtaattaaaagatcgaattcagaattaagtcaattatttgattgtattcatttatatgaaaaaaaatataaaaccaatagctcaaaaaaacattttggaagcttcctacataaatctgattttttaactaaaagcgcaagaagaaaattattaaaatttgaaagaacgtcattttttgaaaagcacaaaaaaacagttaattatattgactttgataaaaatgagtattatgatttcagattaaatgcaatgtataaaaaatagcgctaattattatgttttttaattttatagttctgatttagtttattttgctacaaaaaagttcaaaaaatagtgtttgtgggttcaaaatttagtaaaaaaactattttttagtgtataattctattctagatacatatatttttttaagtcttttagccaccaaaaaaaaaaaaaaaaaaaaaaaaaaaaaaaaaaaaaaaaaaaaaaaaaaaaaaaaaaaaaaaaaaattatatggtataatattaattataagagtaacaatagcaaaagggatcacctgaatccattccgaactcagtagttaagcctttttacgccgaagatactagaaataggaaaatagggagttactctttttttttttttttttttttatgtaaaagagtttagaaatggcatcttttagccaaaaaattaaaattgaaattctctcaaaccggctttcccggccaaaatttttttcgttactaaaaggtttaatttttagtgcttcaaaatttgaggattcaaattttttcatcattagaattaatagaaaagagatttcaaatagattacgtgaaatttttcaatattttcaattaaaatttctcgatacaaagataaataaaaattgaatttgtgttaataaaaaggtaataaaaatccaaaaaaatccacataatatacaatatttttttgctggcctttttattggtggagggtcaatttcacatcttgaatcaaaaagatatcatttagagatttcgttcttagataaagaaaaatgtgaaaaagtcagtgaaattctacaaaaaaatgaattagagtttacttttcgacaaattttccaccaaaattattttaggttatatttaaaaaaggttaacgaaattatttactttttaatggtaataggagcgctggaacaagcatcaaagcttgaaatcttaagaattaaacgtgatcattatttaaacgcaaatcgtattactaattttgatattagtaatgctaagaaaatatctagttcttcagcaaatttcactaaaaaatgaaatttaattcagaaaaacaagttaactgcattttttagtgaaaaagaattgatcttcttcaatgtaagaaccactagacctgaattaaatttacaagaaatttccgaaattttaaaaaagatgtataatattaatataactaaatctggtctaaattattgactttctaaaatgaataaaatacttaagaagaaagaaggagaaaaaaatgaacaataaaattacttacaaccagcgcgactttaaagcatatagtcgatcaacggcctatattcaaaaacaaacaaatcgtttgttaggttattccttattttgacttggaattgccattttatttattggtttattaacttttgcgattttatcaattgatgcactttttgatttatatcaaatttttgtgttttcattattttcaagtatagcaacaattattttaattactcttttaatattaggactaaatttttgaatttcctgatatatcggcaagaatgccttagccgaaaagccgtcaactgtttttttaggttttctattttttgtttttataatcataaattctcttacgctacctttgttttttgctttccaaataattcaaggtaattctagccttgtaatgcttgcagttgctggcgcaggagtaattatggcagtcgttggagctcttggttatttcaatataattaattttggaaaacttctgcctttaattatagcgggaataataattcagtttgtaattggtttagcgacactttttatcttttctacatttttagaaactttatattcaatcatcggaattaccgtaactcttggaataattggttatgaattttggcttatccgcaatcagtcatgccaaattcttgctttttatacagacgaggcagaaattaaacgcgtttttttcagaattgcaatttgaaatgctcttggtttatatatttcatttattcgtttagttatttttataacaagaattatggcttcaaggtattagaaaaaataatctaaaaaacttatttttaaaggatattttataaaatataaatggaaaataaaataattttagttgatattgagataagtaaaggttcaaatataaaatatgaacttgattctaaaacaaaaaaattagtagttgatcgaattttatatggtgattttgtctacccagcaaattatggtagtattccaaaaactttagattgagatggcgatgctcttgattttttagtctattcaaatcaaaaatttctaccaggaacccaattaaatgcaagacttttaggggctcttgaaatgattgatgatggtgaaattgatacaaaattaattggtgtccataatgatgactaccgttttgatcatataaaatctcttgatgatctaccgcaggaatgacttgattcgatttattatttttttagcaactacaaaaattgaaaaaaacccggaattactaaggtttcaaagtttctcaaatatgagcaagcattaaaagaatataaaacttgccaagaattatttaataaatataaggactttaaaaaatctgaatttttaaaattaatgatggaacaatttcctgaaaaatatcaaaaataatttcagaaaaatttgaatttttgtaaaaaccaaataaattttaaattttatttggttttttttctttttaacgaaattatttttgtaaataataaatttttgctttaatatacaaaaaaaaggattaaaaaatattggaatttttaaaaattttttagtttttgtaatataatagaaaatgtaaaataaaaattaatttattaaaaaataattgaaagtcatcgtaattaaaacaattaattaggagaacaactatgaaaaaaaagataaaatgaaataaatttcttggcttaggcttagtttttccgctttcagcaatcgcaacaatctctgccggatgttgggataaagaaacaactaaagaagaaaaatcagccgataatcaaaataagcaaatcactgatgtctcaaaaatttcaggactagttaatgaacgaaaatccgaaattatggccgcaaaagctgatgcaaacaaacattttgggctaaatatggcaattgtagccgctgatggaacggtaaatgataattcatttaaccaatcaagttgagaggcaattcaacaacttggcgctcttactggaggtgagattacttcagtagatagttcaactgctgaacttgaaggaaaatatagctcacttgctaataccaacaaaaatgtttgagtactttctggttttcaacacggtgatgcgatcacaaactgattaaaagtccctgaaaataagcaattatttactgaaaaaaatattatcatactcggaattgactgaactgatactgaaaatgtaattccaacaggtcgatatattaatttaacctataaaactgaagaagccggatgacttgcaggatatgcgaatgcttcctttttggcaaaaaaattcccaagtgatccaactaaaagatcagcaattgttatcggtggtgggatttcgccagctgtaactgattttatcgctggttatctagccggaattaaagcttgaaatctaaaaaattctgataaaaaaacaaagataacaactgataaaatcgagataaatcttgggtttaaggttcaaaatacttcaacaaaagaaagacttgaacaaattgcttcaaaagataaaccttcaacactattagctgtcgctggaccacttactgaaattttctcggatataatcgcaaaccaaaatgatcgttatctcattggtgttgacaccgaccaatcacttgtttatacaaaaactaaaaataaatttttcacctcaattttgaaaaatttaggttactccgttttcagtgttcttagtgatttatataccaaaaaatcaaattcaagaaatttagccggctttgaatttggtaaaaaaagtgcaactgtttatcttggaattaaagacaggtttgtcgatattgctgatacttctttagaaggaaatgataaaaaactcgcaactgaagccatttctgaagctaaaaaagaatttgaagaaaaaactaagacaattcctgccgaagaagttcgtaaaactttagaaattccggaaatgcctgataaacaacctgataagcaacaggaaagcttagacaaactaattaccgatattaataaaaattaagtaagaaaaaataacaattttttaacattatatctttttttagagattaattttcttctaatttagtttaatttaatataaaattatattaaattaaaaaaataaaaaatccggactatttttgttccggattttttatttttgtgttactatttaatataatgataaatcaggattatgcaattgaatttattcaagtctcgaaaaaatttggcagtttttatgccaattacaaaatagattttaagattaaaaaaaacacaattcatgctctaattggcgagaatggtgctggaaaatcgacacttatgtcaacactttttggaatttatacccctgatgagggccaaattagagtcaatggtaggcaatcttttattgataatccaaatcgcgcagcagattttggaatcggtatggttcaccaacattttaaacttgttgatgcatatactaattttgaaaacattattttaggtcaagaatttagtcattatggcattatcaaccgtgaaactgcaaggcaaaaaatcaaaattttacaagaaaaatacaatatttccttcgatttagatcaaaaaaccggtgatgcctctgttgttattaagcaaaaaattgaaattataaaaattttataccgtgattcagatattttaatttttgatgaaccaactgcaattttatcaccacaggaaattgactcatttttagaaattctgaaattttttgtcaaaaatgggaaaactatcatttttatttcgcataaattattagaaattaaagaagttgcaaattcggccactgttttacgggcaggaaaagtcgttgctaattttgaaagtcttgaaaatgttacaatcacggaaatggcagcggcaatggtgggaaaaactgttgttgaatcaaaaaatactagtgaatgccactttggccaattaggcttaaaaattgaaggtctttctgctaaaactgataaggaaatcgttgatttagaccttgaaattcacaaaggcgaaattcttgcaattgctggaattgaaggaaatggtcagttagaactagaacttgctctttccggtcttatagcctcaaaaggaaaaattcttgtctatgataatgaaaataagcctataaatcttgaaaatttaggaccgttagcccgttttggtctaatttcttatgtacccagtgatcgtcataaatatgcaatcgtccttgatctaccaaacctagataattcaattattagaaatttacgaaacgaaaattttgttaaaaaaacgtatatcaaatcacaaaaagtgcaagaattatatgcagaaattctcaagaactttgatgtccgcggtgatttaattggctcaagaaattctagacttttatcaggaggaaatcaacaaaaatttgtcttaggacgcgaaattctaactccccatgaagtacttttaattgttcagccaacccgaggactagatattggtgcaattaatctcgtccaccaaattattttagaccaaaaacagaaaaataaagcaattttactaatttcttatgaacttgatgaagttttagcgcttgcggatacaatttgtgtactcaataaaggccgaatttccaaaaaatttatgcgcactgaaattgatcgctataaaattgggcaactaatgggggagtaaaaatgatgaaaaatttagttaatccgctgcaattttttttcaaaaaaattgacaaaattagtctaaaaagttcttcagaaaagattttttcgactctttgggcgatttttttcggaattttaatgtcatttatttttattcgcgccttcggctataacccttttaaagtttattatacaatgttttttaaaattgcttttgctaaaaatcagattcgaaatctgcttttgacaagctcaattttcatttttgccagtattgcaattgcgattccttttaaagctggactttttaatattggtgcgcccagtcaaatgatgatttcaggggctatttctttgctagttttcttgaatttaacctcaataaatatttatttacgtttgtttttaggtgcttttttgggaataatggcaagtggaattcttggttttttagttggaattttaaaatcctttctgcgaattaatgaagttatttcgactatcttattaaattgaattatttattatataataaaatttttgctaacttcaactaatttagatatcggttttatctcaaattcaccacttacaagtaaatcaattagtgagacaagttttctgacttcaatttttctaacaagaaattttgcggtaataatgttatttttaggacttatttttgcttttttaatctgatttattatgcagaaaacaacaattgggcttagaataaaaattactggacaaaataaaaatgttgcatcttatgctggaattaataataaaattatgactatttcagtaatgagcttttcaggagtaatcgcaggaattgctggatttatttggtatattttttataaacgatcttttacacttagtagcgggatgccccgtgaaggttttgatgccattttggtgacacttctagcctttaattcgccttttgggataatccctacctcctttttttattcaacactttcaatcggcgccagcgcccttgagtcacactcaattcgtttaaatcaggatacaatgcaaattgtgattggaattattatttatttatcagcaatttcagttgtttttgttaattttcagccaataaagtgaattttaaatttctactttttattaagttcgcggcaattttttggaccgaaaacagtaaaatttcgctcattaaaattagaaaaatctaagtttagttggttaaatttagttggtctaaaaaaaattgctcccgaaaaaattgaggaaattaactatgaaattaataatttagaaagtcggcgaattcaatatttagattgatttttaaatgataaaataaatattttacatatttattttaatattcaaaaaattaatataaaattatattttttgaaaaaacaaacactaaaaataaaaaaccatcataatgttttaatttggaaaaaaattaaaaaagatattaaaaataattttggcattaattcaaattttagaaataaaactttagaggaaaaattagcattttttgaacaagttggtgagaaaaaaagatatgcaaatcaaaaactaaattctttaggttattatgatctaaaaaataatcgaaacacctttagacagcaatttatcgagcaacatttacaatttaaaagtctaaaatcagaaattattagtaattttagaatagaaaaaaaacaaaaatctgaaaaaaacaaggaaaaaaaataatgactatagatacaattatccccattttaacgctcttttttctatttttttcaataataactaccggctcaattgctggattatatagtgaaaaagcaggaattgtcaatattgcaattaacggaattatgattattggagcaacaacttatggtcttttttcaattttaatcgggattccaaatatggcaatgcaattattactgattccacttgctgcacttttttcggggctttttgcactcttacatgggtttatcacaataaaattaaagggaaatcatataatttctggggtagcccttaatattctagcaccagcagtctcctttgttttattaaaaatttatggtaaaagtaaccgttttgaatcagttgtaaacgaacttgcttttggacagaacaaggaatttcttaatattttttcacttaaattatttattttaattggtataattgttatcacctgatttattttttcaaaaacaaaattaggactacggatttccgctgttggtgaaaatccacatgccgcagccgctgcaggaattaatgttgataaacttaaatgattaggagtttttctatcaggaataatcggcggaattgcgggggctttttatttccagtatgccggatcaacttttcggggaaatgttcaaggtttgggatttttatcactaacaattttgattatgggccgctgaaaaattatatttattgtaatttcagggctgattttcccatttttatacactttatcaataaatttagccggaaatttcgggaatttcctcccaattgttgaagctgcgccatatctttttacaatcattttacttgctctaagttcgaaaaaagatttagccccaaaagcacttggaattccttatgataaatcactaaaataaatacacgaagaaaaaaatctaatgaaaagggacctaatttaggtttaagagttattttatgtacaaaaaattttttgatggggtcattgaagtaattacagggccaatgttttcagggaaatctgatgagttaattaaaaggataaaaattctaacttatgccgatattaaaactttagtgataaaaccttcagttgattaccgtttttcccagtgcgaaatcgtctcgcggtcaggtttgaaaattcccacttttttggccagaacaacacaagaaatccgggatttatttacaagagataactaccaggcaatcgcaattgatgaaatccaattttttgacgaggaaattgtaacttttttagaacaaatcgccgataaaggaattcgggtaattgtcagtggccttgaccaagattttcgccgcaagccttttggtagtttaccaaatttaatggcaatcgccgaaaatgttactaaattacaagcagtttgctcactttgtaaacgcgctgcaacaacaaccgcgcgtaaagttcttaatgaggcacaaactttaattggtgatcaagacgaatacgaagcgcggtgccgtgcttgtcatagtttataatttttttttttttttttttttttttttttttttttagtttttccccgcgtaattatggtataattattttttgcatacgcaagtgtagtttaatggtagaacttcagccttccaagctgactgtgagggttcgattcccttcacttgctccatatctttttgaccacttaatccttttttgaaaaaatatattgaattattttttcaaaaaaggatttatttaatatttttaaatacaaaggagaagaatggtatcattttctgcagttgtaattgataaattaggtttccatgcccgcccagcttcaaaagttgccaaattagcaagtgagtttaaatctgaagttaaaatttttaatggtgaaaaatcagggaatgcaaagtcaattatgaacataatggcattaggaattaaatctggaactgaatttcgcattgaaattaccggtgaagatgaaaatgaagcagttaaagcaattaaaaatttaataattgaagaaaaactaattcttgagtagctaaaataaataaattttttcttaattcttccaaaaaaaacccgtaataaatgacgggttttttctttttctccataatcttttattattaattatggagaaaaagaaaaaaattataaaaaaatataatttttaaactaaacaacaaaaaaattaaaaaataatgtaaaatttaaggaaataagtttattacttatgcttaaatttaggaggaaaaatgggtttttgttttaaaggtttatttagtagaacaacaaagaaatgttgtaaaaattgtaaatgcaaacaaaataacaactgtaaatgcgaatatgaagcttgtgaatacaatacagctgagcaaatttttgctccttcaacaggaaaattgattaaactttctagggtaaaagatggtatattttctaaggaaatgctagggaaaggattcgcagtccaggtaggaaataccggaaaaaaggacatttttgctccaatttctggaaaagttaatatggtttttcccacaaaacatgcccttggctttgcatctttagataataagacacaaattcttctacatcttggaatcgatacagttgaacttgaaggaaaaggaattgaaatttttgttaaacttaatcaaaaaattcaagctggcgataagattgccgctgttaatcttgattatctaattaaatcaggaattactaacactgatattattgttattgtccttaatgaatcagaatacaacaactttaaatttctaacttctccacagcgagaaatcgacactattccatttttagttggaacaagtagtaaatcctaagaacaatttgatttatgccttttatttcttaagtatggctaattatacactaatttttttattccaaacttttttttttttttttttttacggaaaagaacaataattatgaaaaaaataagaactaaaattttaacttagaaataaaaaacactataaatttatagtgttttttataaaaatatagttataattggttttaaaattttttattattttttaaatatagtgctagaaatttaaaatttattttaaaaagttaaaaatacttataaggcaaaaaataaaaattatcacataaattcaaagacattttgatattattagattattttcagtcgccaaaaacatcaactttgttgatatcgccaaaaccattaggaaataaataagtttttatatttttccctttataaagttgttgcatcgcttggaagtaagattttctttgatgctttgaaccataaattaggtcgtattttggtaaagaatatttaccatagtaaccattataatcatatccatatgatcttaaatttaaagttaaagcagttgaagcaagtctgtcgtttgcaaaaacaagtgaataaagtttatcatctttataaacaccagttcctgacataccggctcctgcggtaaaattatccagcaaggttcctaaacctcaaaataaataaggggtttccttgaaagttcgcgagtgctgatcgtatttagttaccttgataaaacctgaagaaacataagcgtttgagataaaaagatctgttagtccgggcttatttataaaagatcgataagatcttgaccaagaaagatcgccgccatctttaagtttgggatttgataaatccctgttaaaataaagttcatgatccttgttaacatggggtgaaaggctatattttcgcgtatctcaggcttgtttattttgatattcgtttaaagttgaattaagttcgccttctgagactggaaatccgagaccgtaaaactgatttggagctaatttttcatattcttgttcatttaaaaggttagtatccgagataattgtgctttgtttttgattattttttgcatcttggtgctccttatatcaatcccctgttatcagttttgcttgatcttcattatcaaaagttagttccataattgcaaaatcaagtatttcttccatatttttatatttttcttgctcagtgaagtccccaggttttttttcgaatacattagtcccaaaaaccactgtttttacgttaagttcagcattttttggtacttcttgattattatttagtttatcactatagatttggtagttattactttgatctaattgttttccggcattatgaagattacttgattttgttcgcaccgaaattcttatagtatcataataagcatcgcgacgactttcaccagttgttggcattatattattgaggtcaacatcattttttatcttggttagtacaagcgatcaagtattatattgtcgattataagaattataagcatcttcatcacggccataaattgaatcaggatgatagtcatttgcgactaaaagtcggtttaaaacatgagcatttgtgataaaatatcaagtaagcggatatttttggccatcctcttttttgtaatcgagaatattcattgtcccatggaaacctttagaaaaatggacaatttcttttggatctaaatattcaggttcaccttggccgccatcaggacgaaattttagaaaatctccattgacaatttcaacaccaattgaattttttgttaaatttttatattcttgatttggtaaaatccggggaaggccgactcttccaggtccacctcttagtagttggccagttgcctcatcgacatgaagtgccggggatgtatctcctttttgatgttctggaatctcgatactagtaattttaccagaagaatcaaattttgggacaacaaaagttcgataagcggcattatcatataaaggttggccggcctttttagcttcttgattaagttgtgattttagattttcgggtaatttttttgtttttccataagggtattcaactaagccatctgggttttcaagaccgacgattctagccgggccgccgccaaatttttgaataaaatacttatattcatgatcggggaaatcatatttatattgatcagcaacaattcgtttgccgtctttgataatcgctcaattttggcctttaggtgtaatttcctttaatttttcataatattgattaactttatcagctggaatttcttgttttggttgctcaggtacctcctgttttttctcaataggttttaaaatatcattaaaagaaccaataattaactttgttaaatgatcaatttgataattttgtttttcaagttgataatctaaagatttttttgtattatcccagtctctctgtttgttttcaagatcaggatttttgaataatttttcaagatcagctctaatttcatcaagttttttaccaaaattatgataagcttgcttagaaggcaagttttcaaaattttggtattcggaatttagtcgcgcttttagttcatctctaattttttcaatatctttttgatctgtctttggatttgttttctggtttgttgttgatagattttccttgcttgtttgtttagaacaagatcaagatattagtgaaaaagtagtaaaaacaagcccaaaaagtaagaaaaactgcttgtttttcatagaaaagtattttttttgcataatttaccccaaaaaatttaaactagttaacaaggtccgaatctgaagattctgctacttgttttcctacaaaaacttgagcagtcccaattgttgggccaactttattcttaatttcctcgctttcaacataaatctgggaaattccattccctgaaccattagcaacttcgataaatttttgcagctgcgaaattgcatcaccttcgggactaccagaaatataaacgggatagccataaattgattggccatttacttttacaacgacttttggactctcaaagccgctggcaaatctctcggtaaattgggcaccatttagatcagaaaatttgaaatttagacgtttagagccagaattttgcccttttataatcagtttcttgaattttagctgcctaaatccagtataattttcttcagcatatggatcatcttttcaagttctaactttatcattaaaacttttatcaagttcatcaaatttaattcctttaaaagtatttacatcagtttcagaaaaatcaagtgtagtaggccatccaccttttccaccgtgggccccttgaaaaactctttgttcaatttttgaatcaaaaactatttttagaccatcattaatcttgtcaatattatcatttttttctcatcttagcccatcaaaaataattgaaccgccaattttgccctgatttgagccataagatgcttgattattatagtcaaaactaataaaatcaacatttttcagcgcatttgggttgatttgccagtcatcatctagtgaatttttttctgtataaattgataattcttttaattttttattctcaagtccacgaagcgatcgagttgcgccggtattatttagaaaaactgataaagtttttatttgctcagggattgccttgaaaatttcttcggcattctggagcgaatgcgtttcaccgatatttttgattcttaaagcttgaactttgctatctttttgggagatttttgccattatctccttaaatttatcaaaagccttattatcatttgcatcaagttcaattaattttaaaggttgttttttacttttttcctcattttcatcatttggactatattcataaaccttaattgaatttgtatattcactgccaatttcagaactaaattctgagcttttattagttcttgtccaacctggaaaatttccattcgagatatcataaggtgaaagccctcaatatccgggagtattaaaagttcggctttgattatgttttttcatcctgttaattacaggattttttgattcatcttcatattctcagacattcgtggattctgttgatggcaaaagtccttgacgaagtcattttaattcatcgggactaaaggatgttttttctggccgtgattttagctgctgaagatactgtttttcgcgattaagattatattttggcaggtcaatatggcgctcgtaagcttcttttcatagttgtcttcctgctggtgaattaggaattttcccccttacccagtctttgtcaaaatcttcacggtaacggcgttcaatttcttgaacttgcgcttccaaacggctaacactttcttcatatttttttatctcagcttgaagaccttgcttataacggtttaacgctttttcgattaaagaataatcgagcgatccatagtcgtcctttttttcttcagtttttttgggaatttcacttataattggcgcttcaattttctccttaggtattattgccggaggaggcggagttggttctacttttttaggtgttatggttataattggttttatttcctcttttttttcttcaggaggtttgattagctcgactttttgtacttgttttttaagtggtttaaactcagaatttgttacaggggaataaaaacttagatcatttggatcgtttttagcaacacttgagggagctttggaattataactaatctgtgaattaaagcgaaaaaaattactaaactgcggattcgcaaaaaaactcattccggctgcaattacagcaactgtaagtccactcagaacaattttctttcttttcgataaataaaacagcataattttctcctttttttcttagttaatttgactataaaatcctaattatacttaatttagtattttaccacctttttttttttttttttttgcggaaatttaaaaaattttttcaaaaaaaactatgaattaaaagatttttggtctttaaaaccgaaaattaagtaaaaaaaataccttataataattagaaagccaaatttttggtattataagaagactttaaacttataaaattaaaaaattagatgaaaatgatgctagaatcacaaaattatttattatttttaaccttgtataaattgataatttggaagtcaaaaattcttcaattatgaacccaatacttgttgaggattcaatagaattattttcatcttcaagtaaattataatcttctaattttaaagttaattcatttccataaaccttaaagatttgtttggtataatcctcaatttgcttctggaaaaatttaaaaccttataatacatctttcttatccagagattttttaatagccaggccgatagcctttgctaaaagtgggggcaccgcatttccaatttgcacaagttgtcattttttttgaccctttaaaaataaaactatcaggaaatgactgtaagtcagccaactcacgcggagttaaaacccttggaagtttaggatggagattcaccccgccatgattttttttaactgtacaactaggctgatctcaaggtgatttcttccaaccatcagagtaatttttataaacgctttggccttcggatgtctttaaaattttttccctcattttagctgaatgttttgtaaaaatatgattaatttcaatattttcttctcaattcatatatttttcaatacactgacctaaagttttataattttctgggctaagaatagctgcagggaaaaaatttgtcaaaccaatccggtttgcaataaaaattacccgttttcttatttgagcgactccaaaatcggcactatttaatgttgctacattaatcttatagccgattttttcaaaatcttttatgattttgacctcaatttgaccagaaagcatggttctaagtccttgaacattctccattaacacgaattttggctttaaattcgcaacaatatctaacatttcaaggtataaattatttcggggatcatcaaagacgcgattacctgccatcgaaaagccctgacaaggaaaacctccagcaattaaatctagttcttgatccttgaaatgatcataaaattcggattttattttagaatctctaatatcgcttagcttaaaaagttctttattttttgacctttttttaaaattataggcataggtttcaacggcttgtttcattatttctaaacttgccaagggcaaaaatcccgccataacaagaccacaagaaaggccgccagcacccgaaaaaagatcgataaaattataaccattgtgataacttgagctccagccatcaagtttcttcatttcttcatttcttctgagatctcaataaagtggactttttctttagtttttcctaaatttttccttagtttttcttgttttctataggatgattttcatttttgataatcaaattccgaaactagatacttattatttttctttattgagattaaagtttttcttgcaatttctcttctaatgaatttttgactaacagcttcaaggtctacaatttcggaaattttatagtatttcatttctagtctattatatattaattttttttaaatttttttatcaaaaaaaggaaaaatttagttaatttcaccagattttcaccgatctggtctctagatcaagaattttaaaacttataagaactgaatttcttgaaaattcagttaatttatcagcccattcgattgcaacaaaattatcttcaaaataatcataaaactcatcgagttgaccgggaaaattatcaagatcaatatgaactaaattttcatataaaaacataaaattaaaagaaggggatataattttagtttttatcccgatttttttggcaaatttttttacaaaatcggtctttccagagccataatcaccgactaaataaataaattgtactttattttcaagtatttttttaaaaataatctccaaatcaactatagatttggagattatttcttttgaaaaaatataattttttcttatttcttcatagtccataaattactaacggttattcttcataaagaaactaagtggattacggatatcaaatttggactttggttcataatttgaattagttccagctggaattttatgcccgacaataatattttctttaagcccttcaagtttatcgatctgggaagaaattactgaatgaacaagtatttttgaggtttcctgataactcgcggcggctaaaaatgaatttgaaagaagaggaatttgttttgctccttttactattacattcccaaaagccggatttttattctgggagatcagttgaccattaacttcctgataatcgctaatatcaacaatcgatccgataaagaaattagaatcaccgttttcaatgatctgaacttttgaaagcatctgcctgattatgatctcaatgtatttatctgaaatcgaaattccttgcattcgataaattctttgaatttcttttaataggtaattttgtagtgttctagcatcagagacagctagtaattcttttagaataattggtccttcgaccaatttttgtcccggaatgactttatctccgacttttacacgtaatttttgactttgctcaatacgtataatatgttcagctttttcatttttgcttgttttgtactcgatagtaattaaaaatcctttatttgccgcatttttttcggcaagatcagaaattttggttataataccataataaggcgaaatttttgctggcttacctcaaggatgctcatgcgagtcaattaattcaattaaacgggtaaatccccctgtaatatcttcaacattagcaaccccaccggtatggaaagtacgcattgttaactgcgttccaggttctccgatcgattgagcagcgataattcctacggcttcaccaattgaaacaagtcgatttgttgctaaatctttcccataacattttttgcagacactatttttgatatggcaggataaaattgaacgaatctcgacttttttaattccggcagcaacaattttttttgctgtttgtaaatcaaccatggtgcccgcacttgctaatttaattccccgggagtcatagacatctttatttaaaaagcgaccttcgattctttctagtaaaggaacaattatcgtatttgttttagtatcaattatatctttgacgacaaagccaaaatcagaaaaacaatcttcggcaacaacgacaatattttgggcaacatcgacgagccgacgagttaaatatcccgattttgccgtattaagtgccgtatctgtaagtccttttctagccccatgggttgaagaataaaattcaaaagaggtaagaccttcaaggaaagatgacttaactggaacttcaacaattgaacgaactaccctttcattttcagcatcaactttaagagctttaacattatttgccatcaaacctcgcattcctgcaagttggacaaagttagaaatattaccacgagcccctgatttcatcatcattacaagtgaattttgattatcatctttaattgactgatttaaatcttcttggatatcatttttgatctgcgttcatttagcgattgctaaaacatatctttcatcatcggtgattaaaccttttgcataaaaagtgtttaatttattaatataattttcaccttctttgataaattcatgtttttttggcgccattttgatatctgaaatcgcaattgaagttcccgaaagagttgaataatgaaatcctaaatccttaattttatcaagaattgaacaaaccatgttattgtatttgaaccaaattttttctaaaagttcagctttttcgtgatcttctaggacacgataagactcaactggaccattttgttgaagttgtttatataactgtgaatattcaaaaattgtaaattcacttaattttgaaagatggggaactggtaatttttgttttttatagtcacgtaatttttcatagcgtaaaacgcaattttgataattgccaaaatcaagttgatcaattacagttgcaatatcttcttttgctaaaagaccatcataagtatcaaaaatttggcggacaatcttggcaatcgcttttttatttaaaggttcattaacctttaaattttggatatactcgcgaaaatttgttccataaggaaggacatattttttgatctgactaggataatttagttctaattcatcaacattatcatcaaaaataaaaggaaaatttgccgggaaaatgttattaagaataaattttcccaccgttgaaattaaatgtccgcgcatagttttggcaataaaaggttttacctgctcaaaaggtaaaacaacccgggcatgaagctcaacacttcggaattcatatgcttttagcatcgcttcataagttgaaaagaaagatccttccccttttgctccggctttttcctgagataaataataaagtccgagcaccatatcctgagaaggattaacaattggttctccgtcttttgggcctaaaatgttcttatctgcaaacattaattcctgagtttcacggatagcttcaggagaaattggaatatgaacagccatttgatcaccatcaaaatcggcattaaatccggcggttacaagcggatgtaattgaatcgctttggctctgactaaaacaggttcaaaagcttgaattgaaaggcggtgcaaagttggagcccgatttaaaattattggtttattttggatgactttggcaacatgaggtcaaataattgggttttcttcttcaatcattttccttgccattttgattgagcctacttttttttcctgaattaaattgcgaataattcagggttcaaaaagaacagcagccattttccggggaagcccggcttgatgcatttttaatttcgggccaacaacaattactgatcttccagaataatcaaccctttttcctaaaagattttggcgaaatcttcctttttttccagttaaagcatcagaaattgacttaagcggacggccttctttggttgttacttgatttgttgattttttttgattatcaattaaagcatcaacggcttcttggagcatccgcatttcattttggataataataacaggagcatgagcggcttttcatctttttagacggttatttcgaataatgattctgcggtataattcattgcaatcacttgttgaatgacgggagccatctagttgaaccaacggacgtaaatcagctggaattaccggaagattgcgaattatcatcatttttggatcttgaccagagttaataaaagcattaattacttgcagtcttttataaagtttatctcttttttgatttttaagaataattttcttatttttataaatttgtttctgaaccccggcaagttcagcttcaactgccgctttttcagctctaagatcaattttatcaagcaaatattcaatcgcgagcgctcctgttgcaattcgagcacttgaaaattcttcaattatttcattaagttcataataatcaaccccatattcgcggccgattttacttgaagttacatcagctaattcagaaattgactctgctaaggcattatgttcctcgcttccaggaggataaaattcaattatttcaattaaggcgtttttataaattaagccggcttcggaaatgtcaatgattttgttttgttctaaggatttaagtcccccagtttcaaggacaatatgtgatttataataaattagattttcaattgcggctttagtaattgtggtaggaactttagaattaccctcaaaaactttaaggccaagtaatttagcaataattgaatggtcgattttaaaaaatcaaaaatgtaaaatcggcgcatttaaagcaatatgacccattgaataacgccgggccatttttgataaaattcgtgatccacgaattttacattcttttgtagcgatgcatagctgattctcgtttgatttccgatatttccttccacaaactgaacatttataatcaacaaggggaccaaaaattaactcatcaaaaagaccgccgcgctcgggcttaaaagttttataattaatcgtttcgggacgatgaacctctccccttgatcattcaaggacatcctcaggagttgctaaagcaagggaaattttctgaattgaattctcggaaatctttgcatattggcgcgaaacttttgtattcattttttaaattctcctttaaaaataagagtatttttttattttggctataaaagttattatctagtcaacttgtcaaagtcgatattttcttcatcaaaatcagcaaattcttctagcttatttagttcaatccggccatcttgattatattcgtcaatgaaattagatggaatttcgggtaattctaaaggatcttttatttcttcaacttcttgattttcttgatcatttttatgaacttctaatttaatcaaaagtccacgaagttcataggctaaaacattaaatgattctggggttcccggactaggaatttttccccctgaaattatattattataaagtaaatttcgtccttgaatattatcagatttataagttaaaagctcagaaagaacggaagttgccccaaaagattcaagtgctcaagtctccatttcaccaaatctttgacctccattttgggattttccccctaaaggttgctgggttgtaagtgaataagggccaattgatcttgcatgcattttatcatcgaccatatgtagtaattttagcatatacatataaccaacagaaacaggattttcaaagggttggccactaattccatcaaataatttgaattttcctgactcaggaatatttgcctcatcaaataattttttgatggtctcaattttgatcccatcaaaaaccggagtgacaaattttgtttttaattttttggcaaccatccctaaatgaagctctaaaacctgaccgatattcatccgcgaaggtaccccttgcgggtttaggacaatatcaaccggagttccatcttctaaaaacggcatatcttcaactggaagaattacagaaacaacccctttatttccgtgtcttccggccattttatccccgactttaatttttcttttttgggcaatcaagatttttattagcatcccaacgccttcttcgagattatctccttgatcacgggaaagaatctggacatctattacagttccgccctcgccgtttttaacccggagggaagtatctttttgggcaagcgcttttttccctcagattgctgccattaatttttcttcagcggtgggattatcttcaccttttggagaagttcggccaactaaaatatcgccagtatcaacttctgaaccaacaattacaattccatttgcatctaaatgaagacgagatttagccgatgcattgggaatctcggcggtaagaatatcatttccggctttcgttgaacgaaatttaattgtttgctcttgaatgtgaattgaggtaaaaacatcgtcttttacgagcttttcgctaattataattgcatcttcataattataaccatatcaagtactaaaagcgacaagaacatttttacctagggcaagttcgccattatccgttgaaggaccatcgcagatcaactgcccttttttgactttatcaccaactttaacggttggtttttgtaaaattaaggtttcttgattggatttttcaaaataacggaggtaatgaatctccggtttttcgccatcatcaatgatgattttttttgcatcaacataagtaacttttccgctaatagacgcgcggagatttgttgctgaaaaacgggcaacagcttcttcaattccggtagcaacaagtggggcttctgatttaattaacggcaccgcctggcgctgcatattagaacccattaacgctctatttgcatcattattttctaaaaagggaattgcggaagcagaaattgatgtcatctgcattgaagaaacatcaatgtaattgacttgttcggcatcaaggacaagataagtttgattttttctaactgttaatttatcagggataattcgattattttgatcgatttcaactcctgattgtgcaaaacttttatcaaattcttccgatgcggctagccagtgaacctttgaatagtcaacaatgcgattttttacttgataataaggggtgataataaaaccatattgattaattcgcgaaaaaactgaaaaattaagaattagacctatattttgcccctcgggagtctcaactggacaaattctaccataatgggttgtatgaacatcccggacttcaaattgagcagtatcacgatttagaccgccagggccaagtgaggtaacttttcttttacttgccatttccccaagcgggttaatttggtccataaactgcgaaagttttgaggagttgaaaaaatttttaaattgattataaattggcttattattaataattgattttactgttaactgcgaaagatccgattttgttgaaattttttccttagaattcttttcaatttttgtaagtgcaatcaaaaattgattttgtaaaagttcgccaacactaactatccgtttattaacaagcgaatctggatcatcacttttccctaaattacttaataaattaaaataataagaaacaattgcaataatatctgataaaactaaggttttttcattcaaatttggatcagttgcaataacatttacaggctcactttcttgtaacattgattttttatttggtcaaactttaacaattgctacataaaagcgtttccataaattttcattacgggtaatttcaagttgccgggcataaattgttgaatcaactccttcaatttcggaaagaggaatttcttcattgttaaatttttcttgaatttctaaggctaactgccttgtgatataagtcccttttttaaataaaattttatttttttttgatactaaatcttcggcaaggtaagtctgggaaattcgctcgaccaagtttagcttggcattgagcataaaacggcctgttgaagctaaattataacgtctttcattaaaaattattgaaggaataagattttttagaccttcttcggtgatccgatcatcttttctgactattcgataaattagctctaaattttcttcaagtgattctagtttatgtcttctgattgattcaagaagttcaggggaatttccaaaatattttcttactgtctcatttgtaaaaccgattgcacgtaaaaatgataataatggaatatttttatgtttatcgattctgaatttaacagtatcgacttgatttccagtaactttatggaaaatttccattcaagaaccaagttggggaataatttctaccttattaaaaaggtcatctgcttgttgatttctaacattctcacgaaaacaaactcctggagaacgaattagttgagaaacaacaactttttcaaaaccattgattatgaaagttccgccctgagtcataaacgggaattctgctagtaaaatttcctgttcttccatttccccatcttcggaatgaactttgacaagggttacataaactctggcagaataagttttacctttaatttttgcctcgcggatcgctaaatattcattttcaggtttttctacccgaagtgaaccgcggcgaaaacttatttctaattttccatttgctgaaacaattggaaaaattcgatcaaaagcttcgggaatccccacatgcaaaaatcaatcaaaagattcacgcaccggatctagaaaatccggagtttctaaggttttattcgcaaccccataaaagcgacgatcagtgccaattccataggattttaatttatatatgtgattcatttttcccttcttaccattttttcaataagtttttaaattatattagaaacgtaaaaaaataaaaatgtttttataatttaatccaaaaaaattaaagaaaaattttattgggatatttttttatagaaaaataaaaaaataaaaaaataaacaaaaacggtgtttaaaacacctttttgaattttaattaagaactaatttttctaagaaaaaattagtcaatcgaaacttctgctcccgctgcgactaattttgctttatattcttcagcttcttcaggttttattgcctctttgagaactgaaggggctgcatcaacaagtttttttgcatccattagacttagacctaaaagatcttttactactttaattacagcaactttttgttgtccggcagctttgagtgttaattttacttcggtttttacctcttcggtagcaactggagttgcagctactgcaactgctgatggatcaactccaaattcttctttaagtgcatcaacaaattccattacttctttaatggtcatttcttttaatgattcaataaattgttcttttgtaattttagccattttttccctttctaggcagttattttttgttcatcgattaataatttaagtccaaaagcgagttgttttaatggactttgaagaccagaagctaacattgttagtgcttctgtataacttggaagcgcggaaattaatgcattttctgcggcgctgacaacttgattgtcataaattccaccttttagaattaaaagtggttgttctttggcatttttagcaattatttttgctggggctattgcatctgttgttccaaaagcgaataaatttggaccaactaaatcagtttgtaaatctaaataaccgttgttttcagcagctattttaaaaagccgatttttataaacttttgaaagaacgcccgcggatttaaattctttacgtaattgttctaattcattaacagtcagtccgcggtattcaacgattgccaatgatgaagaattttttaataaactatcaatttcagcgacaatttcaacttttcttttacgaaaactattcaattttgctctcctttctttaaaaaaataaggggcaatactgaaagatacattcaaataacaaattaagccacaccggcagttattatctctatgtattgcgtttttgaattataccagaaagcgaaaataaaaaaagtttttttttttttttttttgcttttttttttttttttttttacaggtaaaatttatttattcttaatttaaagtagaaatttttttatttatattatataataagtagtttaaatgaaaagcaacttatccaaatagcaaaaatttttgtttctggttaagttaaaaaatctcaattataccataaaaaatttaaaaattaaaaaaatttttatgaatctgtggtagaattatatctcaatatataatataaataaggaaaattaagcggctgacagaaaaaaaggagaaaattatgctgttttatttatcgaaaagaaaaaaaattgtccttaccggacttacagttgctgtaattgcagccggaatgagtttttttgctaatccccagtttagtaatttttttcgctttaattcacagattagttataattccaaagctccttcaagtgttgctaaaaacgatccaaatgatctaagtttttattcccctgtaacaaattcagaatttgacccgcttaaaaaaagtcagccaaaagcggatctaatcaaacctcttgaagaaaaaaaagaggacataaaaccacaacaaatccaaaaagaagaaataaaaccagaagctgaaaaagaaagttttgatctaattactaccccaaaaacgcaaacaagccaaaatccagaacagacccaaactgagacaccaaaacgtgttgatgccgaatatggatatgtcacccttgattgatcaggcctaaaagttaaagcttatgtcaagaaaaaaccaaatcgccagtattcaacttatgatgtccaaaatggcttagctaatcgcaaaccttaccaggcccaagttgttgatgaagttctaagtattgaagttacccctgaaattcgggaagcaaacagaaaaaatgcagcccaggctcttaaaaattccgttcaaggctcagcttttagtatttatgctgatacaatcgctcaaggcgatgataaagttgctgcagttgttgcccaaaattatgaaaattattataaaaatatgtttttaaaatggcgggaattatttgaaaatggcgataaagtaagagattttctaacccaagaaggttataataaatatccggatatcaaaagcaaatatgaatctgatcttgccaaagccgaaattgaaatccgtaaagctgaagcagaagtccaaaaaatctataatgaaagacccccaagaactggatttgatggctcaggaaaagaaacttttaccgaagaaaataaaataaaactacgtgattgacaattaaaatataatgaggcaatcaaaaaacaagaagcagcaaaacaattaaaagaagatgcaaaaaatactaaatatgccaagttaatttattatcttgattattctaaatttgttaaaaattcaaaagaaaatgatgactatctttcaaaaggatttacaatcaatccggataattccaatatttccgttgatgctgaaggtacactaaggtcaaattcttgatcacctttgattaatcaagtaacttcagtctataaaaaagataatgaaaccagacgagcttttggttatggaagttattgatgaagatctgggggccaaattcttgatggaacttatgaaggatgaactaaaaaagatattacttcttcgcaagaatatgcaaaatattctgtatctaaatcagatggaatcgaaattgccgagctgaccaaaaatacagataatactgcccaaactgctcgcgataaagggatagtaatcacaattgatttttcaaatgaatcagggtataaaaaaacaaaaaaactaatcgaagatcttaaaaaagatggaaaacaaatcacctcttatcgtttttttcatattggaaaaaacgatgcaaaccagaaattcaaggatattctagaaactctcccagaaaatttaccccaacttgaacttttatttgataatacaaatacctccgcccttttagctttagaaaataaaaaaattgatgaactttcaatttataccgaaggaaattcactttctgatgactgagcaattaatccttgagccctaaaaaacacggcctgatataatacaaacgattataatgttagttttgattatgctccaggagctaaagttgcaactagaattacttttaattcattagcttttgatgatagtgactatcaaggaaatggggattataaaaggataaatgatggtctaagaatggcttactgaactagaaataatgaaaaagttttccaaggtagctggggtcctggcctaagtccggatattaaagaatccgagaattcttatccaaccggacttgatcttacaagggtcaaaaaaatgaaatcacttaaaggtctaattttctctgatcagcaaaaatctacaaattcaaaaccaagaagactaactcgaattggcctttataatgactcagaaaattttgaaattccagttgatgaactaaatcatgcccagtttgatgtccttgatacccacccgatgatgcgaccaaaaccaaaaattttctttgcaaataattcagcaacaaaacggattaaagttacaggaaatgggactctaacttctcaaggggcaactaatctccgcattcttttagaaaatggtcgacaaaaacatgatgatacaaaaatttttactgatcaaagaataattgtcgaccctaacaattctgcgcttgctgcttcgcttagttcagccggatttcaagttgatcagtcagcaacttcgcagattaaatttaattaattaggtaataattatgaaaaagaaggcaaattttaaacttttactaacaaaaaactggataattcctagtattttttcattcccttttttgatctcagctgcttgttctagccaaaaacaacaagaaaataaggattctttagatcaaaacggtcaagatttagacaaaaaagagcaaaaacctgcaccttcaattctaaaagatcaagaaatctccaaggaaaatttagataaactaccaattattctaaaaaaaattgatgggtctactaattttgaaaatttaaccattgaatcagttggtaatgatttttccagacttgaatttgaaactccaaatgaagatgatcaaaaattaattgatattaaagttttaaataaaaaatatcttaatagtgattttgaaactagtttaaatgaaggggccctaatttttaatctaaaaatttcttcaaagaaaaatcctgaaattgtccttgaaaaggatgtgccaatttcaggatttcgaaaatcacgaagtagtgaaattaactttaattatggcaaacgttttgcacctgattctgataatgaatgaagtcaatattttgccaaaaataattatcaaagatatacatatgatgcaaaaaaatacatggaaactcttgaaaaacaactcgcatatatctctggattaccttattttgatattaaatcttggcgccctgaagtaaaaagaaatcaagaacaaattaataaatataatgaaaaagcaaaagaacttaaacttgatagctacgaagatgccctaaaaaaaggctttacaatgccagtctatgatgctaatggtaatgttgaaggtcttaaacttttagatcgcgatgaaattcctaaagggccagcctgatgagatctaatcaaccgaaatgagaatcaagcaagcggacttgcccgctatatcccaaatgaaaaatataaaaaagcagccctacaaacttattcagtttattttgcttggccagcaacaattgatgatgttggagctgaatatataaaaccttttcttgaagggcaaagaattggggctaacccgatgcagcaaacaagccggggaacaatgtgaattcttgattttgcccctccaactgattcaagtcagcaaccaactaaatgatattttggaacaaataatcacgtagttgaatcttataaaaaaaatgcaagtcattttagcatgactattttaaaaccggaagttggaattagaacaaaactaaaaactgcaaaaggggcaagtgatgaatcttatttaacagctagtttttcccgagaaaatttagagcaaaatgctaaaactgataatcctcaaaataaaactgctgagtatatctcccctgatggttatggaattcctggaattagaatcatctatcgagcaaccgattttatgacaacttcgccaaaagattttttatcagaagctgataaaaaaaatgaaaaatataaggatattgaagaatttgctgattttgctgtccttgaagttgatttttccaaattcaaagttcccgatcaatattcttcccgtaatgactttatcaaagcaatcaccaatgactattataataaaaaagaagatcatatcaaattcttaaaaacttcctatcttaaaaattatgaaaaagcggatacaaaattagcaacaactgataattccaaaaaagaaaatactgaccaactttttattgtcggatacccgcaggcaactggtgattttttccttgataaatatcaggattcctatgattataatcactcaaaaatcggatattctctctgaatgaattctgagtcttctttttataataatttagccagcgatgagaataatcctgaatcaaaatcgcaagataatgcaaataaaggaaattatttttctttaaatattggttatcgtagttttgctgataaacctggacttgctgatggttttattacagtcccaaaggttggcaaagaacttagtaaatcgacaattatggctgatcctgtccataaaaaacaggtaaaaaaagaagtaatcgaaaacgggaaaaaaataatcaaagaccttggcgaactcgatgttttaaatcaaaaagcttatcttggttatggactttattatattcctagacattttgctccacatgggggggcctcaggatcgtctattcggaatcaaaataatgaacttgtcggtatttattttgtttcaaatcagacggcaaaaacagggcttgcggtcgcttttagatcggaaggatttgactataagggtttatatggaaaatataatcttccccaatatgatttaatttatggcggaggtaaggatcaaaaaacttcgtttcgacaagctcttgaaactatttatggtagcgaatttaaaacaaatttatttaaaaacggggtaaaagaaattccggccgattataaatttaataattcaaattcaaatacacaaaaataagcccgaataattaaactaaaacaaaaatttaaagcttattttgttttgctatctctgattttagaaataattcaaatgtaaataagttaaaaagaaaatgattatggaaaaaacttcgtaatttttctttctctaaacgaagtcctgtaccatcagttattcaaataaattcaaaattaaatttttttgctttttctgctaaagctttaaatctttcaatttccgaattaaattttgacccagaagaattaaaaaaatttgtctcaactacaaaaactttttgatttagcataaaaacaaaatcaaaaagtttttttaattcggttattttttcctgctttttataagtaatttggtatttttttaataaattttccacttgaaattccataaatttaccacttttattttttttatcattacttgataaccctacttcgattccaaataaataattagaaattgatttgatttccggatttataaatatttgattgaccaaacctgttaggtttagaaattcgtataaagaattaaaattatctcattgaaattttttttcattaaaagcatcatctatataaaaaaatgaagaatttttttgaacttttttagctagaaacaaaggcagatactgaaaaatagagacattttccttaaaaacacttcttagttttatattaaaatcaaaaatattatctgattttaatttctcaaatatctctaaatcttttaaagaaagacttattttattaattttatttcaggaaacataatcctttaaaatataagaagtatttcttagagacttaaaaaatacttcaaattcatagttaattaatgcgccgtcatctaccttataatttataataattacctcatttgcagccagaattctatcctggctattagaatttatgaatctgttaaccggtatttgaaaaatactaaattcttttaaattatttaaaactaaagaggtagaatgatttgtaaacattcacttaacttttttagcatttaatttttttaaagtatcaataagctccaatgtatcttgttttttccagccatttctatcataatttgtaaatgaattatcgttttctgaatcatacggagggtctataaaaacaaagtcattttcttttgctagcgataaaatttcaagataatttttattataaatttctatagaattttcatttaaaaatgaagaaatattatttaaatttttaaaatcaaatatagtagaatttataatttctgcattattaaaaggcacattaaattcgcctttggaattcacacggtataatccgttaaaacaggttttatttaaataaataaatctggctgctttttttatgctattttcaggaatttcagaccttaatttgtaaaaaaactccttagaatgaagacttttataaatttctaactgctttgttaaagtatctaaattaattttgatttgcttccaggaattaactaattcggaatttatatcattaacaatagcattttcaggttgtaattttaaaaataaagctccaccacctaaaaaaggctcgatatatgaattaaaatttttgggaagcaaagacaaaattacattaattaactgagttttcccaccaacccattttacaaaaggctttaattcagattttgacataaactaaattatataagcaaatagagataaaattatttaaaaaaacccagaaaaaaagaaaattttcataaattattccacgttttctgtaaataatttcattttttaaaaaatttttttagcaaatgaaattatttacatttatattaattttaagaagttgatagtaaatttttaaaaacagcatcagagtttccaaacaaaaaataagagtttttattatttaaagatgaaaattcaccactacttataaaataattatactttttttaaaaaaaagtataattataatgtttaatataaaaactgaaaggagaccaaattatggtgacaaatgaaaaaactgttattataataattataacaacaaacggcggaaaataaggttaattaataattcacacacacaatcacccttttgttgttcattataatttatatttattaattgctaaaaacaaataaatatataatttttcccaataaaagtcataaaatatgcaaattttaaaaaaaactaaattttcaaaacaactacaaacagaagaattttctaatataaaaattatataatttttatattagaaaatagtttcttaattttatttttatatttttatgaatttttttaaccttaatataaagaaaaataatgaaattatttcaaaatactattcaaattttaaaacaagataaaaaaaataatttcataatttttttactacaaattatttttttgactctcttaaatttacacttttattcctactcttttatccttggctttgtcaaaaaaaaggtgccaattcaagacaaaaattttattttgtgacttttaattagcagcctttcttttgttttttttattatttttaaacttatctatgtttatcactcaaataagaccacctttaaaatttttaaaaaaaacaccaatagattatcagaaaatataagaaaaaaaacatacgaagaaatattaaaaaataaggaaacttatatatctttttacaatctgaatttagatcttacaaattcgcttagtatgacaatttatagccatttatttaagggtgttatttatattatctccagcactatatttatttttttactaagcactaaatcttgaattttaattttacactcgacacttggtgccaccataagtgtgattttattatttaaattttcaccgttaattacaaaattacaaaataaaatccaacaactttttcaaagttatgccggaaaacaaattaaattattcgggttatttaatttgttttactttttcaataaaagaaatgtttttactaaatatcttaaatcacaattattggaaaaatattcccgcgaatttggtctactgaaaaattttcaatataaaacttttttacttaattccggttttttattttttgttcttagtaattctataactttgtcgattttaacatattataaaacattcgatgttaccttatttatttccttgtttagtatgaatttggtaatggtaacaggattttcaagttttttcacctatttattaacagcacaagcattaaatccatatgttaataaaattttcgagaaaatagatactaaaaatgaaaaaaaaatagttttgcaagaattaatttcagaaataaatttacaaaatttaaattttagttacagccccgaaacccgcgttttttcaaatttaaacctaagttttgaaaaaaacaaaaaatatgcgataatttcaccttcaggaaaagggaaatcatcacttttaaagttaatttccggagttttaactaattatgaaggtaaaattttaattaataattcaattgaatataaggaattagaaccaaaacagttaagaaaacatattgcactaacaacaaatgaaaacataattttcgaagacactttggcaaacaacataactttatgagataaaaatcccgatttagatttgctaaattctttaataaaaaagtataaaattgataatttttcaaaaccagaaactgaaattagctcaaaaaatttatctgagggcgaaaaacaaaaagttgcattggccagattagagtacaaaaatttagatatttgatgtttagatgaagctcttgataacattttcaaggaagatgcttttgaaatttacagtgatttactttcaaaaccgaataaaacaatttttatcgcaagtcaccacattcctgaaaaaataaaaccgatgtttgaccaaataattgaaatttaaggaggaatttatggtaaaatctacaaaacatttcaaatttatcctttgaaattgattatatttgatttttacgattttttttaaaatttatctcattgttgctccttattttatttttacttttattctaaatgaaaatttaacttttttttgggtagccacaacatcttttttaggggttagaatttttaatatctttttagattttatgaatcaagcatattttaaagggtttttgatctttcataagatgaaacttgccgaaaaaataacaaattttttggaaaaaacgacttacaaaaaatataacgaaaattcaagtgggttttactattcggaaattgaaaatacaatagaaaaaagcgtttcacaattttatgcaaatttattgtcctttttgcaaactctttccataattttgatgactttaggtttatttttttatataaactggattttagcgttaattattgtcggtgttataaccttttttgtaattacaacttctttactatctaaaaaattaaccaaacttcaatccgcaaaattgcaagcaatttcggattttaacaattctttaagcacttatcttttaactttgccgcaattaaaaaccttaaattctgatgataaattcgaatttataattaataaaagaaacaagaaaaattgaataactagagaaaaatatggtatattttccgacttaatttcattttttaatgaatattccaataattttttctccgcaataatcacaattggaattgcattttggacactttattataaaaataataatagctctgaaattgtttttgcaaatatatctttaattgttttagtgcaattatcgtttagtgagttttttgcaaatgcaaaaacactttttaataactacccagcaataatttcgggatgaaaaaatattaaaaattttgagcaaaaaaacaaacttaaagttgaaaatttagaagaaaatttacaaaatttagaaggagaaatttcttcaattttaattgagaatttaaacttttatctacccgatagaaaattgtttaataacctaacttttaaaattgaaaaagggaaaaaatacataattcaaggagtaaatggttctggaaaatctaccttagcccgaattttattaggagttgaaaaagaatttcaagggaaaataatagtgaataatcattttgatatcaaagatctttcccctttttctttaaataatcacattaattatgtctataataacccaggtattatttacggaactattttagaaaatatttcgctgctagagcctgaaaaaaataagaatccaaaagaaattttagaaaatataaaccttcaaaattttagtttacaggattctctagacgaaaataatagcttatcaacaggtcaaatccaaaaaattcacctcgcacgctcgctttattctccaaaagaaattctcataattgacgaggggctttcgaatttagataaagaaaattatgataaaattctacttaaattacttgaaaataaggatttaacaataattttgataactcatcatttaaataatgaaaatctaaatctttttgatcaagttattaacctaaatgtttaaaattacatataattttagttcaaaaggctttaaaaatgaaaaagcggtttttatttttttatattaaaatgttacttagattttactcaaaaaatttggtggtaaattttaaattacataattgcaaattaactttaaacttcgttgtgttctttgagttttttgacaaatttatttcttaaattctttaaaaaataccaaaaaaaataaaaaaacgtaataaattaaaattaattacattttaaaaaaattttatataatattttttcctgtatttttaagaatagatgagcatatcctagctcatacatttttgtgctttatctcattagttattttaaaaactataatttttaaaatcaacaaacatattagtgataacaagttatttgcaaacagtcaattaactgaagttggtttagtaacgatgttgcaaaaattaaggcaaagggttgaatttaacactttagatcagcaaatgatatttaaaaatcgcgatggtgttcctagtgatcccaatatttgaaataggtatgatttctactttaatatcttaataaatcagtaaaaaaataggtaattaacttttggcaaaaaacttaaaaaagcgcggaaaaccggacacttttttaaaattatctcatcaaagtgggaaactcgggtgaaattcgattaatttcatttttttagtatcttcataaatataaactaagaaaaattaacattaatatattacaaatttattcatagtaaagcttattttttaaatctaaattagaaataaagtcattcatatattcagtatgaatttgattattttgatctatcggtaattttatttgaatagaaggaatttgatttttttgtactcttccatgcccaatagatttgaataatctttcactaataacaatggctaaatagaatttagataaaggaaattgattaaaaatatttctatatttttcttttaaatcacaaatatttacaaaagaggtagcgccaaatttaaaatcacaataataagttttacctccgccgccgtcacctccattaataatacagaatttatcttgaaaaacttcttctactaaatgattttctagtaaaccaccaactccattattatcttttttagcaattataattggtattcctttttcaaatttattttctaattttctatctatagattgcctttgttttcctttagaaataaaatctaaaattttatcaatagcaaaaaatttaaattttatatttttgtacttagataaattttttttctttaaaattacttgattttctattccagagagtactttacttgcaaaattttctttcatatactttttaaaaacagattcttcaatatcaaaagttctattagtattaaatctttcaaaagaaagttcttcatcaaatcttaaattacgttctaaagcctgtaaaggagaaaattgtccttttaaaattttttgtaattcctttatttttaaagcaaatttatcagttttatatcttctttcattagcataaacaaaaccatcatcactaaaatctattaagaaaatattttgtgtatgttcttcaatttccttcttttttgaggctaatttttgaattttcttaattttttcttgactatatttttctagaacaataattgaagtatttactgctgcattaggttgaaatacatctcttggtaaagaaattatatgacttaccttagccatcataaaaatcctttttaaatattctacatttgctttaacccttccatttaaagaagatttaggtacaatagcagcaattttccctttttcctttaaattttcaagagtcacataaacaaatttaagttctgattctttttgactaaaaggaggattcattaaaactttagaatatttatcttttaaaagaggtaattctttaaaacaatccttttgaattatattactacttccatctccatgtaaaagcatattaattccagctaaagtagcattaaattcatttaattcaatacctattaatttattatttttaatatctttacatgcttgattagaatattgttcttctttttctttgcttaattttttatttttaaaaaaagaataaacatcttgaaacatattcgccattgcattagttaaaaatgtaccagatccacatgtaggatctaaaacaacatcattcatagcatctacttgtattaaatcatacatcaactgcgcaatatgatcaggagtaaatacttcacctttttcttttgcatctgccgagtttcattttctaaacacttttaaaaaagcattcattatgtcatgacctttataatttttatgactaatatttataaggttataaacatttgaaataagttcaacaatattatttaactcaaaaatatcaacagttttaaatgtgctattgtataaataattttgtaaattttgaagcttagattttaaattagtattattatcagaatcaggaatttgatcaatagaagcatttttaatactatctaataaagcagaagtagaatttctgttaaactctatgcttttttttgtattgctatatttgtaagctaacataactataccaataaatggaacagtcatttgtttatcaattttagcttctctaaaagcatttgctagttgttttgcaaatcgatttattaactcttcattattttctttagaatttttaaagtatttttctttgtaatatgtatggttttgaagttctttttcttcatgtaaaagtttaaatttacctttttttccatttctaacataaacatttaaatcttttccattatattgaaatcctataatatcttggtgtttttctaattccatataatcaaataattgattttgaaatttagcattctctttttttgcatctaaaataaaaataacaccatcataaaaatagtatccatcaggttttgtagcttgataaccatttttgtcttttttatataaaggaacagatccatctgtttgatttttaagtcctaaaatggagctgaatttttctacaactttgaattctgattttaacattttcatcttcatcctttacatatttttataattttataattttaccaaaataacaattattaattgatgatttaattactttttttagtaacttatttaataaaatttttaaatagaaatttgattgatgaaaaattaaagtagtataatattcattgtagaagtacaaaataaaggaataatatgaaaagaaaaattacaattacagagcacgatgatggttcaattacaatcaaaataaaataattacatataaatacttataaacttctatattaaaaaaataacttaattgttatttttttaatattaatttatttataaaatcaaagcattcaggaaattatgaaactttttagtatcataaactattttgttaatttaaataaaccatctaatatttttattttttttcttaagtttttattgtattcttttttaaatcttcatttatttacgtattcttatttaataaaatttataaaaaaccaaatagaaattcaaaatccagaatttataacttgaatttgtacttcagctggatcttttgctttgttttttatcattgaattaatattaatttttaaaacaaataatgttttatacaatagcaaaagaaaaaatattaattttttaactaacaaaattgcaaaagaatcttatgattatattttagaaaacaaaacttcatatatttctaagtacaatgtaaatttatcagttgctttttcaatgaatgaattaatttattctattcttttttcatcaatttttaatattcctattactattttatttttgtttttgacagaagtaaatatttgaataattattttacattgcgctgttgctttgattatttctattattatattaataaagttttcttcagttttaaacaaattacaagaaaaattggaaaaaatattaagtttaaatgcaaaaaaacaaatcaaattttttagtttattcaaactattttactttttcaataaaagaaaaatttttaaaaccttcttaaaaaatcaagttttagataaatatacaaaagaatttaaattacttaaacagttttattacaatcaatattttttggaaattattttttcagttttcttatttagttcattaattactttatcagttctaacatatactaaaacatttccttgagaatcctttattagtttattttctttaactactagttttattttttcaatttcttcagttttttcttttactttaatctttaaaactcttacaccttatttagaaatttttattactccacaagaagtaaattcttctacaaaaatagaattaaatgaggaaataaaaagcatttcaattaaaaatttaaattttaagtacaatgaaaatgaaatggtttttcaaaatttaaacctggaatttttaacaacgaaaaaatatggaataatatcaccttcaggaagaggaaaatccacacttttgaaattaatttctggtttaatcactaattatgaaggtcaaatactaataaacaaaaaattagaatacaaaagtatttcagatgaaagtttaagaaaaaatatagctttacttacaaatgaaaatgttatttttcaagatactttagagaataatataagtttgtgagataagaatttaaacaaaaaaaaattagaatttttggttaataaatatggaattttagaattttcagatttaaataaagaaataaataattctgttttatctgaaggtgaaaaacagaaaattgcacttgcaagattagaataccaagatttaaatattatttgtttggatgaagcatttgataatatatataaagatgatgttttaaaaatttataaagattttttatcacagaaaaataaaacagtttttatcgtaagccatcatattccaaaagaaattaagcatttatttgatgaaattattgaattgtagaaaaagcaatgaaccaaccaccaagacatttttgatttattatttgaaactgaattaatgtaacatttactattgcttttaatgtttttagtattatttcaccttattttattttttattctattatcaatgaaaattggttttttcttttgttttgaagtatatcttaccttttaacttcattaattttaagattttttgaaataataaatactggttattttaaaggttttttaattcatcataaaatgaagctttttaagcaattccagtctttcttactaaaagcaacatttaaacagtataatgaaaaatcacctggttattactattcacaaataaacaataccaccgagactattatttctactttttattctgaattgtttaaaattatcaaaattatttctattattggaataactttaggaattatattttacttttcttgaatcttaggtttagttactattttaatattatcaattttctttttatatacattatttttatccaaaaaattaagtgctttattggatacaaaattgaaaaaacaatcagaatttaattcgtctttaagtgattttttaaaaaatttaccaactttatacgttttaaataaaactaataaattagaagatgttatagatataagatatcaaagtcttttaacatacgagaaaaaatattcaaaattatcaacttttatttcttttgtaaataagaatacaagcaaattattttcgtttttatttactatatcgatagttgtattttctctttgagattctcataacaatatagataatgaagtaatatttgcaaatatttctttagtaggtttagtacaactatgttttgattctttcttttccaacatagaagaactttttgattcatttcctaatttaatagcaagttgaaaaaatattaagtctttcaaacaagatcttgtatttaaagtagaaaattctgaaaatcaattacaagatttagatggaactttttctttaattagtattaaaaatttaaactataaattggaagatagagttttatttaataatttaaatttagaagttcaaaaaggtaaaaaatatttactaaaaggagctaacgggtctggaaagtccacattttcaaggattttattaggcattgagaaggaatttgaaggtcaaattttaataaataacaaatacgatataaaaaaaataaatcctgattctataaataaccatattaattatgtatacaacaattcagacttaattaatgcatcaactctagaaaatatttcgcttttggaaccgaaaacaaaagatgagattaggccgttattagaaaaggtaaattttgaaaaccttgatttagacaagaaaattgattctgatgttgataatttttccactgggcaaatccaaaaaatccaccttgcacgctcactttattctccaaaagaaattttaataattgacgaaggtctttcaaacttagacaaagaaagttatgtaaaaatcatatctgaacttattgcggataaaaatttaacattaattttcattacccatcactttgattcagaagtttttgctgaatttgatcaggtagtttcactagattaagaaaaaaaagaaaaattattaaaaaataataaaaataatgcttttttcctaattttttcctttttttagtaatttggttaatttttcttaaattccatcaggaaacaaagcggtcttacgatcgccattttcaaagccatttggataaatttcctttaaattttgtctataagatcgagtttgactcgggaacttttgtaggttagaaccatcaattaaattgtaagccttgatagttttctcgccatcgctaagatcttttgaaagtaaaaatggtgtatatgaagctctggctaataaatcccacctgttagagcttagtgctactccgctataaaccccaatcatttgaccaaattcgttataaacaagcgaaccagaagccccaaaataaagggaggaaaatttgatattctgattaaacccataataatcacctaataggcgatgaaaaacttttgtatatgggttaaggttaaaacttaacattttcccttcataatcattagtggagatagcaaacgtgtttgcattttcaggagatcgatgataagattgcattgttttatcgtttctctcaatgggattatttcaagtaagcactgaatttccaccatcaagtccaggatagcccagaacataaacgtttttggaattagttaaaaactctttgttttcatgcatttttgaagctgtaacataatcaattgttggcatataaaaagaaatttttttatcttgattaggaagatcagcttgtttatttcgttttagataagaatctaacgcagccattgctttttttatccaatctttaagcgtttcatcggcgtttgccaaattaacttctaattcaaaaacagcaaaatctgtatataaaggaataaattcgtctttttctaagctgcttttgataattttgctttctgtaaaatcttcctctggttcaacttgtgattttagatattcaagtcgcaattttgatttattttttatatcatcttgaaagggttttatataatctctattaataaaatcatagccagcaaaaattaatttaggcgctgaaaaagctgttgtttttatagtagaattagctgataaacctgaacggtttgcatttgtaaaattttcatctgaggcataaaatttagcttgattatttttattagtcgaaaaatcataattattattatggcttgcgaaaatttggggagcttgaattgattttcctagtgaaatagaagttgctttatccttacttgggtcttcataatttagtttttttccaagattttcatctaaagtattggataaatgcgaggcaacatgcagatttgtcgcaaaaaataatttgtaattattttcatcttttttatgataatctaacagtcaaatagtcccattttcagttgctaaaaacttattctcctcgggttcaccataaagtttaacacctttagctaatgttatgccaaattttactgaaaatgttcgatcgtacagttccttatacaaaatttgaggatcaactgctttatattttttagcaaataacggatattcgtttgcctttaaattcttagttgcaaattgaggaagctgaaacacatctggtaattgcaagctattattaggatttgcttggcttttatcaggaagaacctctacttgttttttttgtgtttttgaatcaatattttcgtttttttcttcttttttggtttctttgatttcgttacttatttgtttttccgacactttatcatttttacaagaaattaaaaagaaaaaagcgggaattattgctaaaaataaaaaatttttaatctttttcatatcaatctctagttttttctttttaattttaacctttttttttttttttttttgcaaaaaaaggtaaaaaaataaaaaaacacactcaaaagtgtgtctttttaaaaaaattaaaataattaagattgactttagcttttcgttagagcttcttgaggaatctcaacttgttgattttttgtaaaatcagaacttaaatattcttggaatgtgtgggcaaatagatctttttgacttgaatctttagttaatttgtccaaatattgaccatatttaattaaagaatcaatatattgaactccctcataaactttttcaatatccctgtttttacctagatttaacatttgatagccgtccccgcccgctgaaagataatcatttgtgcttaaatagtaaaatttgttatcatcaatcggcttgttattaattttaaaggatgttgtatctggttttcaaacccaggattctattttggttttcggatcagtccctttttcaactttgactttataggaaatatttgaagatagttgggcaaatgcgccttgtttccccatagaaagtccgtattcgagagtttttttaagtgtatctccttttagtttaatagttacaatcctattcccaaaaggactaacccctaaaacatctcctcttttgatttcaccactttttagatctgttctaagactaccaccgtttataagtcctaaggaattatcaagtgttgcaatttcatttttcgtactttgtacttgttcttttgaactttttgcatattcccaagcaatggcatctgctgtcattacccctaatgaagttggttttacccgtccaattcagtaaggagttttgttgatctcaattgattgaacatgttcaaaaacaccaggcgaattaaatacttttacatcattttctacatcataaactttatgaagttttttgatataatgttctgataaatctctggttacaatattgatttggttaatatctcttaaagattgtacaatttttactatctcgccagtttcagtatcaaaaactaaatcaatgtccccgagccattttgcataggcctcagtttgggttacccaaacttttttatcttctttgggtttgtgaatttcgatttttgtatgcgaatgcccatcgatgactaaatcaaggccatttccggtttgttctgcaagataatctgaagttcatttatgttctgtgcgcccaacacctaggtgcgttgtagcaattataaaggaaattgaaggatctttttcctgaatctccttaattaccttttgggtttcaggtactggatcggtaaattcaactcaaaaagaattttttgggtgggaagtaatttttgtatctggagttgtcagcccgataactgcaacttttagaccattttctaattcctttattatataaggttggaaaactcgcttcccttgtttaaattcagctggttttatggctctttcatctgtagattctaaatttttaagttcctcttctgaaggttgtcttcagtaaacattagcggaaataaaaggcatttttcggctaaattcatctttgtttccctcggcggcaagatcaagaatgtgtctaattccatagtcgaattcatggtttccaatcgcaactgaatcatagcctatatatttggcaatttttgcaattgtcttacctttatctgtatccgaaagtggaagtccttgaattaaatctccggcagataaaagtaaatccttgttaaattttttcaagtactgtcccgttttatccatccctgaataattattgtgtttgttatcatcatattctaagcgaccgtgttcgtcgtttgtatgaaaaatttttacagttttaagttttgaattttcttttttttctaattcatgcaattttttaaaaagataattgacctgatcaattaggggatcaattttggcttgggcttcgctaataattatagcgatttcatctgtatcactttttggattagttttacggattttgtctatttttgcttggaaatcatttaaggtatccgaatatttctcaactacagaaaaatattcttccctaatcttttcagaattttctttaacttgagcgctattttcagttattttttgagtattttttgtaacctgagtagcgttttcactacaagcagcactaacaattaaaggaattccggtaataaaagttgcaatagtgcaaaaaggtaataaaagtttcttcttcaattttctcctcttattttttgttaaaattgtattataacttaaacgccttaaaaaagaagaaaatttcttaaaatttttcttccttactttgtatatgaataaaaaatttgtttaacctatattatcgaaaataattttgggcgtttattaaagccgaaaaatttttattaatttttaaaaaacacttgtttttatagtattttttgggttcaatataattttttaaaaatttttttaatttataatttttttctatgatataataatttaaaaatttagtttttaatttcaacagcccacaaaaattaaaaaaataaataaaaaagtataaaaatttttaagaacgaaaaaaaatgataataaaattacgaatagttcttttttcattgttttgattgctaaaattacgtaaaatacggtctgtttgaaaaaaatacactaaaaaaaaagtcgaatttgcgcctgaatatcgaaataatttaattttaaaatactcaaaatttattttaaagctttttcgacttaaaataaaagtttttggctatgaaaatttaccaaaaactgctgcagttataatttcaaaccataattcgtttgctgattattttgttttatgctcagctctcgaaaatcctgaaaagggcgaaggccaaacaaaccctatttcaacttttttacttgaaaaacagtattttaatcgaaaaaacaaatgaatttttggtattttggattcactttttttgaccgaagatccaaagaaaaacatcgcagaattaggaagtttcttaaaaactgcccgggaaaaacgtatttatggtatcgtttttagtaagaaaaatgaaaaaaaatcaaattttgacttccctgttaacgtttttaacgccacaaaacagactggactagcaataattcctgtttcaattaatttttctgatgaaaattcttataaactgaatcgcaaaaaagtacaaaatattgaaattttttttcataaacctattaaaaccgccgctgtttttgcccagacaggcaaatctctatttctaactaccaaaaaagcaatttttcagaataatggcggtgataaataatgaattttgatggcaaatttgatgttaaattaggcaacttttccggtcctttagatttactacttgatcttgttaggtcaaaaaatattaatattcttgatattaatcttgtcgaacttgctagtcagtatgtaaatatcattgataatttaaagcaaaaaagtattcaaattgctggggagtatttagtaattgcatcaactctagttcatttaaagtcaaaaattatttttgcatctgataaacaagaagaattagattctgaaactaaacaggaccaacttgaatttttagcactcctttcggactaccaacaaattaaaaatattaccaaaatgttaaaggagcaacaagagcatcgaaatgactattttgagaaaagcacctcaaattatagtgattttcgcaggccgcataaccctaacaaactcgatggacattcatcccaactaattttatcgaaggttttaaaactaatgtttgatcgaataagggcaaaaaatcgtttaaaaattagcacaaaacaagtagaggtcagcgctgataaacaaactctttgactcaaaaatatcttagaaaaaaaaggcaaatttagttttgaagaactttttaacctaccgagtatgaaacattttgtcatcacgatgatttctctacttgaaatggcaaaaaaacaggtgttgcacttaaaacaagaaagtcaattttctgaaattttagtttttgaaggaggttttgatgaaaactagaattattgaggcaattttatatctccaaggggaaaaaggagtttcatcactccaattacaaaactgtctaaaattagcaaaaattagtgaagcgcgcaaacttttaaaggactttgccattgaattcaaccggcaaaaacgcggaattttagtggttgaatttgatgatattttcaaattcgttaccgcaaaagacctaaaaccctttataattgattttgtcagcaatgaaagaaaataccgcctgagcaattcatcaatcgaggtagcagccataattgcatataaacaaccagtaacacgcagcacaatcgcacaaattcggggcgggattaattcggactacattgtcggatctttattagcaaagggaattatcgaagaattagggacggcttcaacacccggaaatccgacgctttatggggtaacttcaaggttttttgattattttaaactaagatcggcaaaagatttaccaaaatttcaagaatttgatctttttagtcatgaagaccaaaattcacaggtagataattttgatcttttttcatcccaacgcgaaaaccaaaaatagttcaatatgaaactaggtcaaattagtgccaaaactacttttgaagaacaaaaatttattttttttaatcaagattttccgcttgagataactaattcaaaaattattggttttatttcaaaccagtcaaattcaattaacgaaagttacatttctagtattggattagtgatagcagagtttttaaagcaaaataatttgaaaaaaattcttataaataacagtgataataattttggaattgcttttggtttaattttttataatattttagcacataattctgaaataaaagttgaaatttttgatgaaagctgaggttattcccaaaaacttgcccaccattattttattaacaatgattttgatttttttattaatattgaagttaatttaacagataaaaattcaagtcttgcaattttgtcatttttcaaaaaaaatttgacctttttaagcgctgatgacgaaaaattaattaacaaagccgaaaaatgtccttttttatcccaaaatagtcaaattaaaaaaccaaaaaaattcagaattaattgaaatgatattatcgaattccaaaaaagcataaatttagacttgcaaaagttagaaaaattctatcaattttatgaacctgaatcgacatttttaactaattttttaaagcgaaactttgacctaaaaacagctaaatttctgccaatcagaaaaaatgctccaatcgaaaacataatgaaaaaaattagcgataattcgataatatggaaaaaaatcacaacaagcgctaaattcaaaacaaatgtagttttttgacttaaacagaataaaattcttgctggctttcgcaaaaattttaattttaatatcataaaagaaaaagatttacaactattatttctagattaccttcgaaaaaattgacaaaatggtagacattttttaattagcaaacaaagtgatagttatatttttgagtttgttcaaaaaaattttaatgcaaaaattaaaagtttttgtgaatatacagaaaatcctgaaactgaaattatcaaaattcaatcacaagaacagcaagaaattgtaattataatggaaaaaagtttttattttatcccaaaaagtgctgaaaaatcaactgtttttggcctaagttcacatttttcagtgctttgatatataaaagtttttgacttttatcttaaaaataaccaaaatattcttgagataatccaaacaatcaaaaccgagattaactatgtcttccatcacaaatttaagttaaaaattgatccagtaaaacttgataatatcataaatctacttatttccgaaaaagatggtgaatttaaacctcaaggctttaaaattaaaaatttttctaatgataaaaatgttataaatcttaaagttaatcttaaaaaaaaggatttttacacgctaacttattttaaaccaaaaaaacaactcacattatcgactaattttttagcaaaaaatcacaccgaaaaacaagctgtttttctcgaaaattctctaattgataaaataaggcttgtaaataaagattcaattttaacaaaaacaaaccagaaaaaaaatataattaaattttcttgttttattacaacaattattgtaatcttaataattttgttttataatttctataattctagtttctctgatggctcgacaacaagaatttttgaaaaattctacgaatttttctttaaacctaggaaaaatcgactagttttcttaggagtttttggccattttcttttatgaaatattagtacaacctttcaattacggcaaatttttaagaatcaagggattaaaacaaaatttaggcacctatttattggtacttttattgccctttttatgcagttttccacaccattttcatttgggggagaaataagttattactggtatttgcaacgaaaacaatacccattaaaaaatattagcgcgactttgacttacaacgctttacttcatcaagtttttaatttgttaattgctattatttttttaccagttggttttgttttttatcctgagctttttgtttttgattcctgggaaaaaattgccttttttacttgattaattacaaatattattctaaatgtgtttgttttgttgataattataataatttcactttgaaaaaaattacaatattccttaattaaaatgcttgtctggcttttaaacctcaatttttttaaaaaaatgaggacaaaaaaagagttgaataccgttttcaatttttaattgacaattttaaaaatcattttattaaaatactttccaataaagccttattaacaaaaattcttttaatttataaattgccactgttttttcttaatttttcttttgttattttaataacagcgatggaaaagggaggatttaatctaaaaaaccttagttttatacattatttgaaatttatttcaggatttacaatcctgcaaatttcaaataatttatcgccctcaccagggggagttggttcggttgatgttattacaaaattaatttttcaaagtttttttaatgaaaaaacaactataacattggatatttttaactttgcaaacagaatttatacctgatttttgccttattttatctcagcactcggaattctcactgtctgaattggagaaaaaagaattgactattaccagcaaattcgccaaactatgaaaaataattcaattctaaatcttgaacttaaaaagcagaatactaatttttttaagtatgctttatttttttggactttagttatattttctttaattttatttatttttcttcattaaatttaagaaaaatttgagctgcttttgctatcattgccccattatcagtacagaattctttttttggaataaccactttatatttattttcatatgttttaattaatttccgaatttctgaatttgccgcgaccccacctactaatgttattgtttttacattttttttagttttaagtgctaaatcaagctgcctttttaaatattttataactgttttttgaaaagaaacagcaatttcaacaacttttttttgcgaaaataaataattttcctttaaattattagtataatttattacttgggttttaaggccgctaaaagaaaaatctaacggattttcaagtacttttggcaggctaaagtcaattagttccatatttcttacattattttgttgccaaattaagtcaattttaggtcctccggggtaaccacaacccaaacttcggccaattttatcataaatttcaccaagagcatcatcaactgtcgaaccaataatttctaaattatttttgttttcagcaaaaattaattgagtatgaccccctgaaatcaacaaggataataccgggaattctaagtcgttttcgattgcagccgaccaaaaatgccctaaaagatgatcaattggaattaacggcttattaaaaaaaagcgagagcgcgctggcaaataaaaacccaatttttaaaggccctatcaatcccggattttttgtatatgcaattgcatcaatagtggaaaaatcgatattttttcctaataatttctctaaaattattgctaaattgcgcgaatgctctcgcgatgcaagctcaggaactgttcctccaaattgttcatggagttcaaattgactaattgttaacaaaatttccactttattttcgctaaaaagtgcaactgatgcatcatcatgtgaagtttcgattcctaaaattttcattttacctactttttttaattttttatttttattttttctatgttatgttataattataatataaaacttaaaatatataatatgggtcagtactcaagaggctgaagaggacgcactgctaacgcgttaggggagttaaatcccgcgcaggttcaaatcctgtctgacccgccataatttataatattgcttgataaaaattcgttttatttctaattttatcttgttaattgataaattatactcttattttctttacaatattttattgtttttattaatatctaagattttttaaatttcttttatttgttttatattaaattttttactacgaaaatattaaaaaaataattatttctttttcattttttagtttgatattcattttattttcctttatatttaatatttattataatttgagtatatcatttaactaaataataatacaattaaagcaataaaaaaccagaaatttcttaattttgaaaatttctggtttttttttattaaaataattcaatatattttagctatttatcaactttttttagatttttatactcgaaagttgctggagttcggcgaccaaaaacactttcaagctcgacggttattagggttttagttacattcatctcgatgattttcccaaaatcatcagaaaaagggccatgggttactttcactcaatcaccgatttctcaattaattgtgccgtcgtttgtttgttgaaaattaagaatttgttgatctcatttttttctcattctttcaaattgacgcggtgaaattggtgttggttttgttcctctaccatgagacccgacaagtcctgttacatattgggtattacgcaccacaaatcaagccttgtcaaccatattcatcttaatgaaaaaatatcccttatataaatttcggtatttcagctttttttctcctggtttattaggattttcttcataataagggacgtcaaatttcgttatttcttggaaatgttcctctaaattttcgtattttatccgatttttgagcaaactaatggcagtatcctcttttgaagaaatagttgaaatcatataccacttgtaaattttcataacaaaactaaccttttttttaaattccgacgccagcctgattccaaataagtgccgcaataaccgtaactgcaaaaaaaacaaacataaaaattgtggaaaaaagcaaggattgaccaaaacttttaaaggtaacacggccgctaggccatttcactcttttcatttcctttataaaaagacgaaaataatacttctttttacgtgtttttttcagttttggcgttttaatcggtctttccaacttttttccctttctatttttcttcctgatgtaaggttgatttacggcaaattttacaaaatttattaatttgcagacgattttgcactgatttgcttgttttataattccgatttttacacaagctgcaacttaaactaattttctttttcatataaattataaactaaatttattagataacttataattataacctaaaaattaaaaaaaactacgtaatttattatttgttagtcgaataaaatcattgactttctgggttgtaagtcctatttttttagcaatctcctttgtcggaaagtcctgaatgaaaaacatttgaaaaatttcgtattcaacttcatcaagattgctagtaattcggttgtaaatatcttgaatttcatagtattcctgatcggattcagctgcaaattggactgtttctgataagtcatcaagtgaaattgaaaaattggcaatttgataattttttgttgtaaatgaagttgcataacctaacataaacaatttaattttatgaactaaataattttctagtggaattcccaaactcggatcaaattcttcataaagatttacaaatttttcaattgaagcgttaaataaatccaaataagttagcggaatttgattaaaagttttcattacctgttttgaacaagctaataaaatatgtgaatatttatttaaaacctttaaacagcgtttatttttttttatcttttcttttcgctctggtgacatagaaaacacattttttccctttatatttttgttttttttatattttgttttagaaaaaaaagaataattccggtcgcgactgtcacatttagcgagttaactgttccttcaagcgggataaaaaaagtttgatcacttgcatttaaactgctttttttgattccagttccctcattacctaaaattattgcgcaaggataattaaactgaatttcctggatttttctacttttttctttaagatcagtggcataaattcaaaaatccatctcttttaatttattaattgctgaaacaatggaattaactaaaataaatttaaggccgacaaaaccaccagatgagactttcatagtggtctcattcaattttgctgctcgccttttaggtaaaattatatgcttaattccaaaacaatttgcagttctaatgatatttccaagattattttggtcctggatatgatcaaggatcaaaataatttttggtttatcttttactaatgtatcaatttcaaaaaatttaaaattctcaagaacaccaacaaaaccttggtgattcagtctgacaagtttatctaaaaaatcacgactaactatttttactttttgttttaagaaaatttgatcatttgtaggttttaaaaggtaaatttccttaaaaataaacccattcttgatcgcgtcggctaatgaatttctgccacaaatatatttaaccatactttcaatctttcaaaaggaagatggaaaaaattatgaatttttaaatatttttcataattcttcacggattttatcggcctcggaatagtttttatccataattaatttgtttcaatttttgattttttcctgactttcggggtccaaacgcatttttgtgaaattaaatcttaaatttagaaaaatttttcttatagttgaattttctttttgttttattaattccataattaaaaaattagcttttgcgaatttgccctcaataaataaattaagcacttgttcaactttttcagtcttttcgttttttttgtcaaaatatcactcaaaacagatcttttggtatttttcgattaattttttatgatttttaattaattcttcagttaaattgattggaactgttgggtttattgacaaaaaaatacttctaataatatctggattatatttatgcgaaaaattctttgccaatagtacattattcagagatttggccattttttttccatttaaattaacaaacccagagcgaaaccagttttcggcaattggatttcccgttagagcaaaatgttgagcattttcgttttcgtgatgaggaaaaattaagtcaaccccgccaccatgaagatcaagtgattttttttgaaaataatcatagataagtgctgcacattcagtatgtcaaccaggtcggcctaaaccgaacaaagacttaaaaaacaagcctttttgggttttttttcataaaacaaagtcattttttgactttgtttttttagtatttttatccagtaatgattctattttttgaccagaaattattccgtaattaggaatttttaatatgtcaaaaaccaagtcattgtttttgttataatatgtaaatccctttttttctaaaagttttatatattctataattttttctattttttcggtcaccttaacgatttttgttggcttttttatattaaaaatttctaaaattttaaaatattcgttagtatatttttctgttagctcagcctcagaaatgcctaattcttgtgctttttcaataattttatcatcaatatctgtgatattatgtaaaaaatttatcgaaaaacctttgtttttcaaacattcaaaaatagcatcaaaaataattatagttcttaaatttccaatatgaacatcgctataaactgttggcccgcaaagatagatatttaaattttttttattaattaagttcatagtcatttaattttctaattaattccttataattaggaataatttcagctactttttcccaaaaaagtttattatgcttgctaaaaaaatggtgcacaagttcatggacaataacataatcaatgatttttttagaaaaaggaagtaaaaaatagctataatgaattttttttcgccgataatttgttccccaggcagcatttttacgcgctattttgatttcatagttgggaatttccaaaatttgagctcaataatttgtccttttttttagataatttaaaaaaaaattcattaaaactttttgaattttggcttctaaatttcgcgctcttgttagggagaaaactaaattttcagcttgtaaaaaaagtttattttgcgttttgactaaattatagtagtattttttgccaaaaagataaaaactagactcagaaaaattaagtataacacgttttggcaaaattttcactactttttgaaaaaagttagaatttttaactatttttattagttcctcaagttttactgccggatttgaacgaaccaaaataaaatcatcaaccatttttattataattttagaaaatttgggtgaataatcaagaaaaattgtgtaaaatttaccttgaaattctaaaaccaattttttatacctggttttcatttttggttatttttacttcaatgttgttggcatttttactaattatttcgaattctaaactatataaaggtgatctaaaataaattttatctcctaaaatcagcttttttttgggtttttgggctaaaagtcattgatttagatctttaaaactcacgggcaagtcaacctttaaagctttgttaattgttacaatatttgtctcagccttagttgtaatctgatttggattgatctggtagaaatctagatcatcacggtagtcatattcatcataaattggcccgaataaacattcaagaatatcctcaaaagtaagaattccaattatttttttattttctacattatcaatgacaaaaccaaggtgagattttgctttttttaaaatttcataattagtcttaatcaaattagtcgccaaaagtaaaggagtttcgacaatatggtcgttaatgtcgaatttatcaagatacaaaatatcttttgaaagtagaattccgatgaaattattctcttttcagactggaattcgcgaaaaattgtgatcaattatcacattttttattgattcaagactatcttcgtaattaacatagacaagatctttcaattttgtaaaatgttttgcggttttaaaagagtcaaaatcaagcgctctgatcgccagatctgattcttctttttcaagaacttcttcgcgctgggcttgcaaaattattttttttagctcattttcggtattagtaacatttatttttttgacaaattttgtcatcaaggttgcaagtgggtataaaaaataataaaaaaaaccgataaaaaatcaaaaatattttaaaaataaaatcggttttttgcgcccgaaaatctttggataaatttcgccaaaaataattaaaggcggggttgttgctgcaattgagatcaaaatctgcagtgattcattaatcggcaaactggaaaaaaaagtcgaaattataatcgaaattccgatatttacgatattatttcaaattaaaatgattgttaaagttttttcataattatcataatagcgtaaaatttgcttttttccccagaaagaatcagcaatattttcatcaacttttacccgacttgttgcagtaaatacagtctcgcttgcagaaaaaattgccgaaataaagaataaaatcactaaaacaacggataaaatagcaaaatataaggccattattcatccaatcctaaattaatatttgcttttttattatatgaagactccggaattgcaggactaaacttgccaaattcaggaaaaaaatcaaaaaataaagttccaatcggtccatttctatgttttgcaattataagtttcgtatttgggccctgttcttgatcgggtttctcctcttttttgtgataataatcctcacgatgtagaaaagcgacaatatcagcatcttgttcaattgctccagattcccttaaatccgatagaactggggttttatcctctcttctttcaacatttcttgaaagttgtgaaagtgctaaaataggagtttcgacctcacgggctagttgttttaattttcttgaaataattgatacctcgacttgacggttataattttggtttcttgtagctgaattaattagttgtaaataatcaaaaataattaaatcatattttaggttatttcgatatcttttttgaacttgtcagtaaatatcatcaatattaatcgatccagagtcattaattattaatttacagtttttaattcgggtttcaattgccttttcgattgcttttaaatcttccgctcttaaattttttgggattttaaattttccagattcaaccccagaaataagcgaaagaagtcttgtaactaaatcagaattagacatttcaagtgcaaaaaataggacagatttatcattttcacaaatatttcaagctaaattaagggcaaaagctgtttttccgactgaaggccgggctgctaaaattgttagatcacctttttgaaatccagaagttaataagtctaaattctcatatccggtcgaaattcctttaattaaattttgactagtacgtaattctgttaaatatgcgaaaatttgaactgcaatctcataaatcggaataaaagtttcatttttagtattaaaattcagaagatttattttttgaagaatttctgtggttatctcataagaaaattttgttccggaatttagttcttttgttgaatcatcaacaattttttttagatctcttaaagtttttttttcatttattattcttaaatgttcagtgatttccgaaggtagcgaaaaattgctgttatataaatttacaatgtagttgcgcccgccgatttgatctaatttacccgttctttcgagttcctgaagaactagggtaacctcaggattttttgtttgatttgcaacattttttattgctcttacaatttcagctaaatttctaacactgaaatcatccggattaagtatgtcaataaaattaacaactttttcaggatttgctaaaagaaaagagatgataaatgcttcaagttcaggagaattataacgagaattattcatcttttgtgatatttatttttaatttagcaatagtttgagaacttaattttatatcaacaaaactagtgccaaaagtggaaattccacttgtttggattgcttgtttatcaacaaaaatccctttaatttcaagttcttttttaatttttttagctgtaattgccccatgaactgattctttatttccctttaatttaaaccagagaactagcttttcaatttcgatttttagtttggcaatttgttcctgtttttcttgtttttcgatctcaatttgctgttttcttttaactaaaagtttttctgttcgggcatttaggggctcggctaacttattcttgaataaaaaattagtggcatagccaggggaaacatcgataattgtattcgcttttccatcttttgtatctttaattaggattactttcatattctctccttttaattgctagtttgatattattgacaaattcagaaaaagtctcaactgttgaataagcggctgccgaattaaaactaccacccccaccaacctgctcggcgatatattgaacattaacagtttcaagacttcgagctgacattttataatttttttgttgcggtaattttgcaacaacaaaagcagcttgccgatttttaactagtaaaatttgatcgcaggcaattgcaacaagatcggtatcaatttcacgatctagacttgaaagaaaaaatccttctttaatttcaacaacattttctaaaatttccttaattgtttttgattctgactcgtttagtttaagaaattcggctgtttttgctgtttttgcgccccatttaacaagagccgaaacagctgaaaatgttgaagaacttgctgttttttttagttgagctgagtcaatataaatcccatttagtaaaatttgggcccattcgggatcgatttttagatcagaatgaaaggttaaaaggattaaatgcgtgataatttcgcaggttgaagaagaagaaacatcaatataatcatgaactagctccaaaagtccttgcattttcggggaaattccgtgatggtcaaaaataaaaacgttttcaagactgatatggtcaaaagctttaggattttcaattctttcaagatcagagacatcaactaaaatggcaagacaagtatcattattttttgaagctaaggaaatttttgttgaagtagctggtgaaataaaaatttcttttttaattattgattcagactgggataaaaatagtgtggtggtaggatcaaaggtgcgattctggatataaaaatttaccttttttttatagataatttcggcatatctttttaaaaagttacctaaaacaaaggctgatccaaaagaatcaaggtcagaattaatatgaccataaatgataattttatcaattttttctaatttttcaaccaaaatccgcgcaattcgttttaactttacaagtgaatgatgatttaaggattcgctataagatccataagaaaaaggtttttttccatagggataaattgaaacctgattaccaccgcgcgcctttgagaaaattagggcttcgtttgccaatcttttgatttcgactagatttgtagtggcaattccaaaaccaacagaaaatcaaacttgagttgtatcatcaattttcgtatttttttcatgaaaaatgtagaagtgatttttctgtcaaatcataaaagtttcataatgaagaactaacataatccggccatctgcatattctttgtataaaaagccaaatttttgtgctagtttttcaaagaaatcattaataaaaattttgattttaggatagtcttgatcactactgcgaaaattagaagaaacaagattatccacctcaatttcggcaaaaacaagcgaattattctcatatccctgcgaaattgacttaaaaagtgtgatatctttataagaaattcaatagtcaaatttgttaaaattaatctcaaatcaattatttccccttttgatctcaaattttgagggaatatcttctgtttttttatactgggggaaaaggtagaaaatatcgcgattaatcagtctttcaggatataaatttttaacatattttgaaacttttactattttataggtcgatgataaattaattattccaagattgttttcctcatttattagatcaaatttttgataataaaaatggttttgtttggtgataaattggtataaaacaactattccaatggataaagagatgataaaaacagcaaaaacaataacggcaacggcaaaaaaaaggtagaaatcaaaactatcataaaaaataacctttaataacaaggtcaaaatttctgctaaaaagcttataaatgaaactgaaaagggaaataaaaattttttcatattttaattatttttgagaataaaatttagaatttttctcgggatataaatgacttttattatttgcttattttgcaaatagttacgtattttatagtcttttttggcaatctcgatgatttcttcttgtgatttttcatctgttaattcgagaattccgcggtttttcccattaattgaaacaggtaaatgaaaagtatttttaaaaatttttgaccgatcaaattgaggtcaaatctggaaatttaagggtttttgtcctaatttttcaagtaattcttctgctgtatgcggtgcaaaaactgagaaaataattaaaaaatctgtcagataattttttgaaggaattttttgctttttatttagaaaattaatgtaaaccattaattttgaaattgccacattgaacttaaaagtttcgattaaatttgtgatttcgaaaacaaaattattgaaaaaatacgtaaattcatagtctttttcaagttcggggtcaattttatagtcagctaaaattgttctttgtacccgttgaattcagttaaaaattgaaactactccattttcatctcaaagtcgaagatccccaatcggacccataaacattaaaaaaattctaattgtatcagcgccaaatttgtctatgatttccgtaggatttatcgtatttcctttagatttcgacattttttgaccatcagaacctagtaacattccttgatgaattattttttgaaaaggttcagaatttggaactatccccgcatcaaataaaaccttatgtcaaaaacgggaataaattaaatggccaaccgcatgctcctgaccccctatataaagatcaactggcagccattttttgaatttatcataggcaatttttgaatcaagcggcaaatatttatctttttcttttaaaataaaagctagataataccatgagcttccgcttcattgtggcattgtatttgtttcccggcggtagtatttcccatttttttcaaagaaaactcagtcttttatcgatgcaagtggggactggccatcaccagaaggcataattttatcagtatgtgggagctcaactattttctcttcaagataaatctttcctttttcatcaaaataaaccggaaaaggttctcctcagtatctctgacgggaaaaaactcaatcttttagtcgaaaaattgtagttttttgaactaaattcattgaatttagcttactgaaaatagaatttgctccctctttaatagtcaaaccagaaaattctgcagaatttataagtaaattttcttgatttattactttaacataatcaatttggaaaatttgagcaaattctaaatcagctaaattatgggcaggaacccccataattgcagaagttgcatagttatttagaacataatttgtaatataaatcggaattttacttgaatttaaaggatgaaccgcatataatccagtgaaaattcctgtcattttactttgtaattttggacttgaaaagctgttttgctcaataaattggctgattttttccttatttttagccaatttttgagcaaaattatgtaaaggtgcaagggctaggaaacttactccataaaaagtttcgatttttgttgtaaaaatttcaagaaattcaccggttttttcaattaaaaatttaatttttcacccttttgatttaccgattcattttttttgtaaagtttttaaagaatcaggaaaatcaacttgatcaagtccatcaagtaatttctgtgcatattcagtgatttttaaaactcactgtttcattttttttaaaattacaggaaaatttcctctttcactgacaagcgcaccatttttttccctttttaattcctcatttgctaaaacagtgcctaattccgggcatcaattgacttcaacttcgcgaatctcagctaaatttgccttatataatagtttaaaaatccactgagtttggacataaaattctggatcagaggtgttaatttccttatcccaatcataagaaaatccaaaagaaattatttgttttttaaaattttcaatatttctttttgtaaattcacccggatgattacctgtttttatcgcatattgctctgcaggcaaaccaaaagcatcccaacccatcggatgaagcacgtcaaaaccatttaaacgtttaaatctagcaacaatatcagaagccgtatagccaatcggatggcctagatgcagaccagaagccgaaggatagggaaacatatcgagaatataggctttttttctagatgtctcggttgttttgaaaaccttatttttataccagtaatcttgtcactttttttcaatagctcggtgatctaacatgatagttacctaaattatagcataaatttttaaaattaaaagccaaaagtgacttttctaaaaaggaaaaattagaaatatttaaaaaagtactaattccaaaagcattttttgaatataaaaaccaaaaaatgcttaaaaacaaagatgttttgtgttaaaattttcttaaaaaattttaaaaaagtaatcggttttaatatgttaattgaaaaagaatttaaaaaattcaaactagttgcaaattataaaccaagcggtgatcagccaaaagcaataaaaaatttaatcaacgggataaaatccggaaaaaaatcccaagttttgcttggagtaacaggatctggaaaaacctttacaatggcgaatgtaattgcctattttaacaaaccagtaataattttatcacataataaaactttagcctcacaattatatagtgaatttaaagagtttttcccggaaaaccgcgttgaattttatatttcctactttgatttttaccggccagaagcttatttgccaacaaaagatgtctatttagaaaaaactagtaaaacaaattttgaccttgaaactatgcgaatgtcagccctaaacgccttgatgatgcgaaatgatacaatcgttattgcctcagttgctgcaatttatgggaccttaaacccggatgaatatcaggataatttcttagttttagaggtagatcaggaaataaaaccaaatgaattagccctaaaacttgccagaatcaagtatgaaaataatcaaattgagcaaaaaccgggaattttttctttaaaaggtgatgttttagaaatttttccagcttgaagcgatgcttttaatatcagagtggaattttttggaaatataattgaggcaataaacataattcatccagtttcaaaatcaataataaaatcatataattctttcacagtttatcccgcaactgcttatagtgtgaaaaaaaatataattaacagagcgatcgaaaccatcaaaattgagctgggtgagcagctcgaattttttgaaaaaaataataaattagtcgaaaaacaacgactaaaagaccgagtcaataatgatattgactcgctttctgaattcggaatttgttcaggaattgagaattatgcccgccatattgacggacgccaaaaaggcgaaaaaccatttagtttactagattatttaccccaagacggcctaatttttattgatgaatcccatattatgatcagccaaattaagggcatgtatgaaggtgatcgaagccgaaaacaaaccttggttgactatggttatcgactaccttcagctcttgataatcggcccttaaaactcagtgaatttgagaaatatcaacaggcaaaaatttatgtttcagccacaccggccagctatgaaattgataaaacaaatggcgaaattgtctcgcaaattatcagaccaactggactaattgatccagaaatagtaattgaatctaccaaaaatcaaatggagaaaatttttcagtatttgctaaaacagaaggaaaaaaaagaaagaagtctcattttaactaccacaaaacgactggccgaagaaatcagcaagtatctccaggaagaaaaattacaaaatgtctattatttgcactcagaaatgacgacttttgagcgcgatgaaatcataattaagcttcgaaaaggaatttatgatgcaattgtcgggataaatttacttcgtgaaggcgttgatatcccggaagtttctttgatttttgttcttgaagccggtcttgtttcttttttgcgatcagaatcttctctaatccaaattatcgggcgggctgcccgtaacgatcatggaaaagttatcctttttaccgatacagtcactgaaactattgaaaaagttttaaaagataatgaaaataaaagaaaaattcaaattgaatacaaccaaaaaaacaaaattatcccaaaaacaataaaaaaaccgattcccgacagcatcaatccaaacagtttgaaaatcagcaaagtccttcgtgaaaaacaaaaagacaaaaaagagatggaaaattacatcaaaattctcgagaaagaaatgaaaatagccgcagatgcaaaccgttttgaggaagcaattcaaattcgtgatttgattgccgaaattaaattaaaaatttaataaattataagaaattcagctatgaatacaaaaattcagataatttttgggcaaaaaggtgctaatttgacctttttagattcacaaagtcaaaagaaaataaaagtgaaaatcccaatttttacaatatgttttcaaaaaaatataccaaaataccttaattttaatctaaaatttattttaaaattaagttattttgaaaattttatttattgacttattgagcaaaatttacttttagaaaaacaaatttttcagcaaaaaatgctgaaaaataaagtattttgtttaaaaatggtaaataattttcacttgttattctgaaaatatagttttaaggatattataatttttattgaaaatgatgaaaattttgcttcttgatttaaacaaaattttcatattttcaaattagaaataaagaaataccaaaaactttttctgacaacaacagatacagttccgggaattgccagtttttacaaaaattgcgatttagatgcaatttttgtaatcaaaaaacgcgatttttcaaaaaaaattgttactttagtagctaatttagaacaaataaaaccactaataaaacaagaaaattataaaaaattaaagaaaattacaaaaaaaatctggcctggagctaccactttaataatagaaaatcaatcttttcgcatcccaaaccaggtcaaacttcttaaacttcttaaaaaaaacgggccagcatttgtcacaagtgcaaatatttccaatgaaaaacctctagatcttgtttctgcaaaaagaaaattttggcaaataaccaaaatttttaatttcggacctggaacaggaaaagtttctagagttttcgaccttgataataaaaaatgaattagaaaataaaaaaatccctaaaaaagggattttccaaaataatttgatatggtgggaacgaatgggatcgaaccatcgacctcacgattatcagtcgtgtgctctaaccatctgagctacgctcccgtaaataactattttttaatagtttttatgttaattcattaaaattataacaaattttttaaaaaatgaattaacgttttgaaaattgccttgctcttctggcttttcttagtccaaattttttccgttctttggcacgggcatctcgagttaacatcccagcaacttttaatcctggccggtagtctgcagaaactttcaacaaggcacgggcaattccaagtcgaattgcgccggcttgccccgaaattcctcccccatgagcattaactctaatgttgaattctgaaactgtgtttgtaattgacaacggctgcaacgcatctttaatcaaaatatcggattttaagtactcttttgcaacacggttattaattttaaattgaccatttccgtgttttaaagttactcgggcaactgatgattttctacgtccagttccataatatgataattctggttgattcattttctattttacctctaatttttccggattttgacctaaatgtggatgttctgatcctgaatagacataaagatttttgcgctgcttatcccctaattttgtatgcggaatcataccataaatggctctttctaataaagcaatcggttttttcgcgcgcatttcacgggctgttctcactcttagaccaccaggatatccggagtgattatagtataacttttgctcttctttttttgcggtcaacaaaattttctcagcattaataataataattttgtcacccatatcaacattaggtgtaaaatgcggataatgctttccgcgtaaacgcgaagcaacaaaagcggctaaacgacccagaattttggattctgcatcaattacaaaccatttttgcttgacttcttggtgcttgacaaaagttgtctgtctcataatcagcctttcattttagtggttttgagtgcaaaaaaaataagaaaaaataataaataagcaaccaaatttttggttgtcaagaatgtattaaaattatacaatattttttaaaaaaacaaaatattttttttaaaaaatattgttaaaataaaagtcggctaaccttatataagttaccaaatcaagctgttgaggtcttatattttgagcaaattgaaaaaaattataaattttttcaatttgctgcttatttagaaaaaaaataagattattatatagagtttttcgtttaaattgaaagcatttttttgtaaaccaaaaaaattgctccgtttttttggcatccaagtttgttctaagatcaaaaaaaacaacagctgaattgattttcggctttggaaaaaacgaatccggtccaactacaaacaattttttgacatgcgctatatattgtgatgcaagcgataattttgaataagttggtgtttttggtttggcaactattcgatcggcgacctcattttgaaccattaagataattttatcaaatttttcaaaatttgcaaagattttaaacaaaatttttgaggtaatatagtaaggaaggttggctataattgtttttttttctttaaattcgagttctgcgagcaaaaaatcttcgttaattatacgaagatttttattcttgaattttttttcaagaattggaattaaatttctatcaatttcataacaagtaacaaattttgctttttcaagtaaaaaatttgttaaaaaaccggttccacaacctatttcgataatttctttgtttttaagatcaatattttcaactattttttcagcaatttttctatcttttaaaaaattctgacctaaatgcttcttaggaaccggtttttgcattttttactttaaaaattttccttacatttctataaattatttcagaaagttctgtttttgtcaaattttttaaatttgctatcgtttgataagttcactgaatttggggagaaacatttggtcaaagttggcgattcggttcagggcttaaataaggcacatcggtttcggtaaaaattttctcaagcggggtttctttaattattcttcttaattcaatgctttttttgaaggtaataactcccgaaaatgaaaaaaaacagttgtttttctttactaatttttgaaatatttcataatttgttgaaaaattatgaaatatgaaattaattttagaaaatttagttacaatttctgaaattaatttcattgcttgattttcacctgacttatcgcgaatatgtaacataactgggattttttttgattttgcgatttgaatttgatccaaaagcgcttttatttggacatcttttggcggattattttcatagtaaaaatcaagaccgacttcgccgatggctaaaactttatcatcaatatgattttcaagtagggaaaaattatcattttctgcgaccaaagttggatgaatccctatgattttatagattttttttgaataattacctatttttttaatttcttcaagatattctcatgaagttccaacaacgaaaataagtccaatattttttttaaaccaattatcaacttgtgcttttgaatcttgaaaatattctgaaaaaggatggcagtgaatgtcgataaattcgtatctttttaccaaattaaacttaaaagtatttgaattgccatcaaaagatatggcaaatttttgaaaaaaattattaatttttgtgtccaaattgctaatttgaacataaaaagtttcaaaatgataattttcttctataaaatcgagaataaattcaccaataatattaattcagtttttatctaaaaactgactaaaaaaaggcagatttagataaaaagtttgttcttttcttgaaagtacaaaaaaagcaaaaataaaatcagcttgtttatgctcatcaacaaccaaaaattcataatttgtttcaaaattttgataataatcaaaattactgattttatttttgcctttttttgttactacatttaattctaaactaaattttttaatagttttctgaaataattctaaataccgcggtaaaaattgctgaatttttaaatacatagttaattttgataattaatagataaaaatttattataattttgttttattataatacaatttttaattataatataaaaggagaaagaaataaaatgaatattgatgcaaaaaaaaatatcatcctttttggaatggaaaattcccttgacttagccaaaaaaatttcgaaaattacaggaatcccactttctgggattgaaagaattgtttatgctgatggcgaagttttactaaaatccaaagaaacaattagaaattcgactgtttttgtagttgcaaatacctcccgccctgttaatgaaaatattatggaacttttaatcttcattgactcgttaaaaagaggttatgcccaagaaattatagtaattctttcttattatggttatgcaagacaagatcgaaaatcatcaggaagacagccaattactgcaaaattagttgcaaatttacttgaaaaagcgggaataaccaagctaattttagtagatattcacaatccaagtattcaaggtttttttgatttttcagttgatgaaattcatggacagtatattcttgcaaacgaacttgtcggaaaaaataaggactatgttgttgtcagtcccgatcatggaggcgcggttcgggcaagaattctagccgaaattttgggtaaacaaacaaatgttgctgtgattgacaaaagaaggacaggcgctaataaatccgaagttttaggactaattggcgatgtagatggaaaagattgtataataattgatgatattatcgatacaggtgggacgataattaatgcagcgaatgtcattagagaaaaaggggcaaaatctgttgttctagccgctactcacggcgtttttagtcatggttttgaaaaatttcaggaaaatcctaatattgacaaagtaataattaccgattcaattgataataaaaaacttgctaaaaagtttcccaaacttttgataacctcgcttgccgaatttttgtcaaaaagtattttagcctgcattttttcgacttcaattacaagtatttatgaagaaactaagcaaaaattaattaaaaagaacctaaattaaacacttttttaaaagatttgaaatgtataaacgattagttcaggaattctttcctaaattagattttgaaaatttagaaaaatacgtaaatttaattgaatttagtaataaaaactttaatttaaccgctttttctggtgatattctctgaaaagagggaatttttgagtcaatttttacaatgaatttcattgttggtctagtaaataataaagaaaataaaaaattaaaaattttggatattggggctggatcaggttttccttcaattccttttttgattacaaacccagaaattgagctaacaatttctgagtcaatgcaaaaaagatgccagtttttaaaggatgtttctgaaaaattagatttgaaattcaatttaatttgcaaaccagttcaagaaattaatccacaaaaatttgatataataactgccagagcagtggcaaatttggaaaagcttgagaaaattacaaaaaaaattcattttccaaaaacgcttttagcttttattaaagggcccaaagtttttaatgaagttcaaaattgtaaaaattgtaattataaaatcattaaagttaataataatataaataaaaaaatttttatcgcatttaaacaagtttcttaataattttgaattttaatttagaaaatataaaaatcttgttgatttttatataattttttaaccttttttttttttttttttttttaggaatatggtaaaatttagtccatctatcaaaaatatagaaaaggaaaaattatgaagaaaaaagcaagaaaattcttaagactaacttcgcttacactagcgcctttttcggtcttcaccactcttatttcagctggttgtttgcaaaaaaattctttgctttcagaagtaaattatttagccctaggtgattcactaacagctggatttaatgaagaaacataccgtgattttcaaggtactttagataaagatggtaatttaagcggtcaatcttatcctgcttattttgcttattatctacaaaaacttaataagaattcacttgtttcttatgataatttggcaatttctgggacaacaacagaaaactgactttaccttcttaatccaaccaaatatccaaatggaaaaatgagcgataatccgttagttacaaactattcaggaaatgaaaaatataatgaaataggctctgtttttggtgattttaataaggattcctatcctggtttagtcgaaaaagttaaaaaagcaaaccttttgacaatgtcagtgggagctaacgatccttttttagcaatttttaatgaatttaaaaaatgagcaagtataataaaaccaaaatcagaggaagcaaaaaaattactagatccaaatgaaagagcgaatttcctagcagaaaaaggaatgcttttaaaggcggaagttaataaaaaaattgaggaaataaacacaaatcttgataatttaattaaagaattaaaggcgcttaatccaaaattaagtataaatttagttggatataaattgccaaattccggttttattaagattttaaagtatcttttatatacttatgcaaaaattgaaacggactttatcaatgaaattcccgaaaaaattaacaaaattattcgtgaaaccgccattaaaaataaggtaaattatattgatgtctatgataaaagtatttgaaatgattctgataaaaatttaatggcgaaaaattttgacttccacccttcaattcaaggttataaaaaaattgctcaccaacttttgttaaaattaactcttgaccaagaagaaaaagatgattctaatgctgaagagctaaaaaatactacaaatttcgatgattttgatgagaataaaccgacctattccaaagttattgacctaagtgtttttgcaaaatcaaataaagaatttcttgaaaaattaaacgaaaataagcaaactagtgaatttattgctcaaaaatccacttttgacaccgatcaagaagctgcaatcaaagacgacaaacgcacttttggaaatatagttcgagaaattgtatctttaccaatcttcgataattttgattttagagagttaatacctgttaaaaatccatttgtaaaagcaattattaacagctatttagggaaaccagctggttctcttataaaagatatcgaacaactcgaaaataaagtgaaagattacgcaagacctaatatcaagattttcgatacaattattgactcattcataagaaaaatggtagcattttttgctgaattaaacactgatcaagaaataaaagaattcaaaatgtcacctcaaatactatttctgacactaagaaatgcaatactaagtccatttgatttaactaaattaaaagacagtgctacatttaaaattttaatgaatctcaaaccagaacaaatattaactctactaggcctaggtaaaaccccttcagttcctaaacctgaaaaaccaaaagatcaaggttctatgccacaaacagatacttctagtcaaaaacaagaaagcggaacaggttcaacagattcaacaaaagctacaactgaaaaccaaaaaccagctgagcaaacaaattcttctgagcaatcaagtaccgattctaaatcaaactaattttttaataacttataattataaaaaacctaaacttatttcagtttaggtttttattttctaatttcaaattagaaaataagactttctaaaaaagtcttattaaaatgttaaaaaaaccttgttttttatagacttttttaaattttttattataatatataaggaaaaattttagtatttctgactgtgaaattatgaagttaataaaaattgaaattgaaggttttaaatcctttgctgaacctgtaagtattaaatttgatggttcaattgttggaataattgggccaaatggctctggaaaatccaatataaatgatgcaattaaatgagttttaggcgaaaaatcagttaaacaattacggggccaaaatatggatgatgtcatttttgctggctcaaaaacagttatgcctgttaataaagcgatggtaaaactgacatttttagatgaaactcgtgaagatagtgcccaaattttcacaatttcccgagttatcaaaagaggacaaggaactaatgaatatttttataatgatcaattagttcgctataaagatattagaaatttagcaattcaagctggaatttccaagtcttcacttgcaattatttcccaaggaacgatttctgaaatcgccgaatcaagccctgaacaacgaaaacaagtaatcgaggaagtcgccggaactgcaaaatataaaattgataaaactgaagctctaacaaaattagatcaaaccttgatcgcaattgaaaaaattgaaatcaggacaaaagagcttgaaaaacaagtaaaacagcttgaaaaacaagcagaaaatgcaaaaatttacctcgaaaaatcaaagcaattagaatctgttgaagtcggcttaattgtctctgatattaaaaagtaccaaacagaattagatcaagtccaggaaaaattaaatgatctaaaatttcaagaacctaaatttatcagcgaaattgaagcaaatgagaaaataattattacaaatacacaaaaaaggtcagaaattgaagctgaaatcaacactaaaaaccgcgaaattcaccgcctaaaagagcaaattaataccctaaatttagcttatgcaaaagcaactcaacttcaagaaatgattttatcaagtgaaattagtgtaaattttgagcaaaaaatggctgctttgcgccaaaaatatagtcttataagcgcgcaaaaagacaattttgcaaaattaatcagccaaaacaagctcaaaaaactagaaattgaagaaaaacttaatacatttaggacacaaaagggtgaaattgaaaggaatttatacagtctaaattccgaaaaaattattagtcaaactagaatctccgagctaaaaaagtccttagaatcaatgtcttttttgccaaaggggacaaaaatcattatcgaaaatagctttctttttcctggatattgtgggcttgtctctgatttaatcaaaattttcccaaaatatacaggcgcaattgaagccgcattgggtccaactttaaaacaaattgttgttgaccaacctgaaaccgcagtttcagcaattaattttctaaagaaaaattatgcaggaagcgcaacatttatccccctttcaacattaaaaccgcgatttattcccgatttatatcttgaacatctaaattcacaaaaaggttttataaatttagctagcaatttagtcgattttgaaaaaaaatacaagattttagcggattttttactaggagggattattgttgctgatacaattgattcagcaaatcgaatcgcaaacttccttaaccacaaaaacatgatcgtaactttagacggcgatgttattagaactagcgggataatttctgggggtcataagataaaaaatgattcttccttttcaattcagtataaaatcgatgaactaacaaataatttgaatttttttgaagaaaaaattcaagaatttaaagttaaatctaatgaatttgaacagttaattacaagagaatctgtatttttacagcaaattaatattaatcttaatgatttagagcaaaaatttagtaattctgaaaatgaattaatcgaaattaaagctcaaaatgaaggtcttgaagagagtctaaatcaaaaagatgacctaaatttaagtctaaatcgaactttaaaagaaaaaattgaacttgaaaatgtggttttagaacttgaaaatcaatgcaaaattttaaaaactgaaaaaaaacagctcgataatcaaatttcagaacttacagttttagttcaagaacttaaccaaaaacagcgaaaaatcaacgcagatcttaaccaaaatcaaaattacaaagacaaatatgaatttttaattacaaatttacgaaataatttatcccaaaaatacagtctaacttttgaaggcgcagctcaaaaatatgaacttgaaattcaagaaaaagatgctcgcgaatttgtaaatagtctaaatttagagattaaagcgcttggaaatgttaatttagatgcaattaatgactttgaaacaacgagtcaaagactcgaaaaactaaaaaaaagtcaaaatgaacttgaaactgccaggtcaaaaattttagaagttatctcggatttagataaaattatcattggaaaaacccaggaaattgtcgatctagttaattccgagtttaaccttgttttccagaatatgtttggtgggggaagtgcaaaaatttattttagtgataaaaacgatattttaaattcggggattgaaataagtgcccaaccacctggaaaaactatcaaaaatattaggcttttttctgggggcgaaaaggcaattattgcaatttcacttttgttttcaattattaaggcaagaccaattccgctttgcattcttgatgaagttgaagctgcccttgatgagtcaaatgtgatcagatatgtggaatttctaaagcagttaaaacaaaaaacgcagtttttgatcatcacccatcggcacggaacgatgtcccgagttgatcaacttttaggaatcacgatgcaaaaacgaggagtaagttcaattttttctgttgaactttcaaaggcaaaagatcttttaaaagaacaattacagtaatttttcctaacattttttctaaatttttttgctgaaaaatgttgatatggaaaaagcgaaaatttatggtataatttctaaactaacaaaataataaaatttagaaaaaaggagaaaaacaatggcaagagaaggtttaactctaagatgcactgactgtaaaatggaaaattatattactaaaaaaaacaagaaaaccaaaccagaaaaaattgaagtcaaaaaacactgtcataaatgcaacaaacacactttgcatagagaaaaaaagtaaaatgaaccgcaaatatttagaaaaagcgttttttgataaccatttagatgtaattatttctttttcattccaaagtcgactctgactaacgaaaattgcggcctccgatggaattttatttattgaaaaagatcaagcttttttgtttgttgatggtcgttatattgaaaaagctgaaaaagatgctaaaaattgtcaggtttttttaactaccaaggcaaatcttgaagattttttcaagaaaaaaccgtatcaaaaaatcggcattgaatctgaatatttaactattgaacaatttgataaaataagaagttgatttccaaatgccgattttgttaagttacaagcccaactttttcgaattataaaaacagaagaagaaatcaaaaatatcgaaaaagctgttgaaatctcactcgcggcttataataaaatatttccaaaaatcaaaccgggaatgacggagaaaagtatcgatgtcaacctaaattatcaaatgaagcttttaggagccgaaaaagaatcctttgattcaataattgcaactggttctaattcggcaatgccgcattgaagggcgagtgaaaccgaaattttagataatgatcttttaaaaattgattttggtgcgctttttaacggttattgcgctgatattacaagaacttcttatcttggacagattagtgaaaaaaaattagaaattttggaaatagtaaaaaaagctgctgaaattggtagaaaaaaagttgctcctggggttaaagccagcgaaattgaccttgcttgccggaattttatcaccgaacaaggctatggaaaatattttattcactcaactggccacggggttggtattgatatccatgaattgccagttgttagttcaactagccagacaattttagagcccggaatggtaataactgttgaacccggaatttatatccctggacttggaggcgcaagaattgaggatgttgttttagtaactgaaagtggttttcgtaccttgtcacgaaaaggtgaaagaatttagaattgaatcaaaaataaaaattttttaaccttttagataaaaaaatcattaaaaatgaaaaaagcaaagcgaaattataaaatttggacactaacaaccttagtaccaattttttcaatttctcaaggttgttctgaggttcaaaaattaccggatgtaaatcctgtttctaaggttataaaagccggaaatgaaactaaaaaaattgaggatgaccaagaaaaactagataaaattgaaaaaattgaaattaaaacggtaaaagaacaagaaaaatctgagactaaaaaagtggttcctgtaaaaaaaccagaaaaagttgaaaaaattgaaattaaaactataaaaaaacaggaaaagcttgaaactaatacaaaaaagcagcccgaaataactagtccaaaagtagaaataaaaaaaactattaaaaaaacagaaaatcctggacaaaatgagaaaaatgttgatctaaaaccaagtcaaaaaccagctgaaaaacagcaggaaattaagaaagccgatgttggaataacacgtaaaaaagaagaaattttgaaaaaaaatgagcctgttaaatctctagataaaaatgaaattttacttactgaattaaaggctcatcttggaaatctgccagatcaaattcaggttgctaacgcacgaaaaaatgataacccaatgacattagtttataaagcaacaaatgaatacaaaaatctttcgtattataatattgtaaatccaattggggaggataatgaaaagtatgagctaaaattagacttttttaatgcaaaatacaacaaaaacggacaaaataaagacccaattgaaaatgtaaaactaattttatcgttaaaatctaatcctaatataaaattctccaaagttgttactgttttttatcagaaacaagaaaaaactgaaaaaaattatattttaaaaactaaatttcctgaagaattcaagaatatctatccatcttttatcgcttttttaatccttaatcgcgaaaaagaaaatgttgtttccttacctttttttaatgaagatggagttattcttaaaaataggaaatttggctttggtctgcagaatgaactcgtagaatttaaatctaaaaatctagaaaacgacaaggataaatatacttttgaggttttaagcgccaaagctgatgatgaaaacgggaaattaagtttaaatctaaggctgtgaaaaattaaggatagaactgaaagaaaagaaacttttgctgaaattgagacagtagaaatttctggttttgcgaaaaattccagtaaaaattacgagtttaaactagctgaaaaagattttgagataaatcttttaaaagacaatctaaaaaataaattaacagatgaaaaattgaaatcaagctttaccaaatatgcatttttaaaaattttatttgaaaaaatgcatatttggtcaactattgaaaacgagaaaaaattaataaaaataagtgatctaaggattggaaattgaattgtttacccgcaattgatgtttttagatttaaatcctatcaagtcaattgataatttaattttgacaaaaaacgggaataaaattacttgaaagctaaatttagaaacttatttattagacaaaaatcaaactttaactccacaaagtcaagattttttattaggtcaaaagcaaattcaggaaattcaaggtagtttaaatcttgatcaagtcaaaaaaaattagtaaatttaacctttatttactaatttttaataattttacaaaaatgatgtaaaattattaaatatgaagtctaaaaaaacaaaaaaatatattttcttacttttgaatccggttgcacttcttttcctatcagcaagctgctcgaatacggcgcctgcaacaacaaaaatttctaaagaccaaaaagaggataaaggtactataagaaaagaagtggaaaatcctaaaaaatctgaggaaaaaccaagtactgaaaaatctgaagttagcactaaaaaatctgaaagctctgaagaaaaaattgaagaaaatccaaaaaatgaggccgtagaaaaaaaagatgaaatcgctaaacaaaaagatgaaatttctaaaccaaatggtgaaaatccgcagcctgaattagacaaaccccaagctgaagacgaccatcaagtcgaaaaaatagatgtcaaaccattcaatccaaaagaggatcaaaaagatgatgatatcaaattagcgcaactaaaaggctatctttccaccctgcctaacactctttatattacaacttcactccaaaatgaccttcctttgacaattattcatagcggaaaaggcgagaaaaaagatttaggctatgttaactttgtaaaaccaattcaagactttaatgatactgaatacgaggcaaaacttgatttttctgatgcacaacaaaaagaaaacaagaccaaaaatccaattgaaaatgttggtttagtgcttagtttgaaagacaataaaaaaatcactagttcaaaaaaaattagacttttatatactgaagaacaagaaaataaatcacatttaaaggcaaaaagtttaccggaaagttttaaacatatttttccttcatttttagcttttgcactattaaataaagaaaaagaggtaatttctctgcctttttttaacgaatcaggttatgttttaaacaatcaaaattttggggcgggtcttaaatcaatttttgcagaatttaacaacagtgaaaataataatcaaaaagataaatttggttttgatgttgtcagcgcgcagcctgatgatgaaaagggggaattaaaactaaatttccaactttgaaaaataaatgaaactaacggtgatcaaaaagaaatttttcctaaaatcgaaagtttaactttttcaaacctggcaaaaaattcagataataattacgaaatcaaacttgatgaagcaactacaaatacaaatttaaacaatgaagattttgggctaaaaaacgcgggtgagaatctaaatacatctaaatttaagaagaacgaattcataaaaaaaataatagataatatacgggtgaatattaaagctgaaaatattaataacaagtgactcaaagttagtgaagcaaaatacaaaaattgattgatttttccgcaaattcagtatgcaaatttagactcaacaaaactaattaataatttaaaacttgaaaaacaacaggaaaacaaaatttcttgaactttgaacttagaatcctacttactcgataacaatcaaattctaaccccagacagcgactttattttcggagaacaaaaaaaaacaattacaatcaaaggcgaaatgcaattaagttaagttttgaaagaacaaagggctattattataccacaaagaaaaattaagggaagatttttttatttgtactacctccttttttagtttcgagtgcggacaccataaccgctctaatttttataagtattttttaattctctgcttaaagagcaattggatttttaattataccacaaagaaaaatttagagaagatttaaaaaaaaaaaaaaaaaaaaaaaaaactgaaaagacagggcaaaatcattttctagtgtaaacacagttttttaaattttaatttaaattttaattttttaaactacccacaacaatccagcaccaaccaatcaaatagtttttatattctaccagaaattagaaaaattcaaagaagtttttagaaaaaagtttttaaggcgaggattaaaattcttgactcttacagttattagaaatcattctaccagaaattagaaaaattcaaagaagtttttaaggaaaaagtttttaaggaaaaagtttttaaggaaaaagtttttaaggaaaaagtttttaaggaaaaagtttttaaggaaaaagtttttaaggaaaaagtttttaaggaaaaagtttttaaggaaaaaaacactattttccatagtgtttttttatttttttaattattaattattaattatttatttaatttaaaagttcatttattccctaaatagccccataaagtgtttatataatctctctgctttttcaacagtagcggcttgatcaatactttcatcatcaggaaattcatagatccctaatccttttagggccagatatccatcaccttcatcgtcttgggcttgggtattgttattatttgtagtattttttaaaagccctccgacataatttaaatcatcataattaaattttgtcccttcagcgaaatcaattgttatatgctcaggctcatcagagctatcattagcaatccaccaaagatgaagttttttgtcttgtactagtagaccaagtcttacatcaatttggttcggatcaggattttggcttagattttgacttggcgaagtagttgtttttctttgagtgtttgtaattttaatttgattacgccctgattgttgggtatttgatcgagaattggttgttagactatgcgtacttggggagtattggatttgattgttatctgatggattttcgttttcgagtttggatttaatagtagttcagagaacttccccttgggaattattattcgaaattccaagaactgtctcaccctcggtttttaaagaaccaacagatgttcccagccgggttattcatatttgggtattggagttgttgttggagcctccgttattgttgtcttttatcccagatcctacaagaattcattctttttttgttcccgggttttttatagccccttttagtagtactaactttttatttggtttggagttagtattggtattacctctgctgcttccattttttattccctcttttatcttagtcccaccttttttaacacggagcccctcctcggtgatctcgagcttagtcttttcgggttcaggagatgccatttgaggggaagctaactgacttcaaattagctgcccttctctttctgttttaatctggtttcttcttgtataatctacaagaagtactggatcttcttggactaagtagtcaatgtatttattagccataaccccttttattataagatttcgggttaaggaagttaggtttttactatctggatttgattttgcctgggaagtattttcttttagaatcgctgttatttttagacgatcattaaagctatctggttcaacaaggaaatctcaggtagttcctggtagagttttatattttgaatttactaggaaatcccaaagaattaatccaagtcctaagttttctttatttgttttagtatctaataattggttagtttcttttgttttttcttgtttttgtttttgttcttttacttgttgtttttcttgctcttggaatttagttgtttttactttagccgaagaggctgaagttgctgctgcttgtgttgaacttgttgttgaagttgttgctgaacttgttggtgttgaatttgaacttgaatttggagtttctgtagatttattttgggttgtacccgccatacttgaagaagaagtggttttactattagaatcattagaatttgaagatgaagattctgcttgggctgattcaggttttacttctttttcattttttgcttgatctggttttgcttgacttgttgctgtagcaggttttatttcgttaataaacttgtttttgtgtttctctttatattcttcgaggtcttttttactttgaggtagatgatggaaatctaaataataaagtgttttcgcgacttcatcatctaagaaggttttaccttcctttttatattggataacctctttgactaacttttccattctccctaaagttattcaatctccttcagggttatcctcatattgaaattcgattgctaatagatcgtcattgttaagatctattgggctaaacgtcttactttcaattttagcttgtaattctttttctctttctggattttcctttaataaagtattaattatttctctttgttttgcactatagtcaagttgaactttaaatcttgaagataaatttccaagatctaaaaggacaacttttgaatttgaccccttacctatttttgctagcgaagcttttaaaaccgggggataatttgatctaacctgactagaaactaaataaggggctctaatatcgctaacaacttttttaagactaaaatctactttgagtactacttgttcattttctaataatttttctttttcattttcttcaatatttctatcaaaattaattgaattaactttaagataatataaaggaagatcgggaattggaattagtctcgaccttagatcgaaaaaactaaggaaattttcctttgctttctcgaaagaatcttgctctgatccattagaatttggttcgtttttaagatcctcttcttgaaatttagtagtggatgtattattatccacctttttgttgttattgtgttcttttagtttatctaatattttcctaagatactccggattattatcatttttatagataatttcagacaatgataaattatcacggattaaacctaattgaacataaggtttaatctcaacaaattcagttactttttgaagtactttttcctcttgttttttaagatcaaaatcaagttttttgattcccttaattttaaaatcgtattcggatactaatttaccatttggatctcagagttcaaaagtaatagaaagcgttccatttggatcgcttaagtttttaaaggctaaattttctactttttgtagtttattaacccttgcgcggtcgttttcatttatatttactaatttttcttcgcttgcatttttattttcaattgttttgggggctagcacataacccttttggagcatagtgggcaaaccttggcggttaactaagttataaccaagataattttttatcaaggcctggcgaaaagcctcggctcttgatcctgtttttttatatgcaacttgaaagtcattatcaagccgaaaagccatttctgaggctaaaagatgcgcgctttcaggggctaaggaagaaagtgatagacctgaaagctcttgattaatttgataatctataatatcatcgccaaaatcatcttcttcttttcaaccttttagagaagttagtcttgaataggtaacttgatatttttgggaatatgcactaactactaccgcttttacttctttattagccgcaaaggcatcggaaatatccaaagaaatcttaaatgaatgttttgtaattggggtgtagtcataagtatctaaaaagttaaaggcattagctgcttccctagcaagtcctaatgccattcttgctgttagatgtctatatttatcaaaaagtttaagattttcaactgctcttataaaatcttcttctgagaagattagatctgagtctgattttaaatccacgactttgtttttatcgactcctcctgaaacttgggaactaaatgatttctcaaaaattgttagtccaattgggactgctacaactgtagttgcaattgatgtcaccgaaaatccggttgaaagaattgcttttgctttattatgttgtttctctttttcgtcaaattggttcattacttatcctttcgaagatataatatttttacttcgccgctttagcagcagctgctgcaggagcactagaagaagatcctgaattttggctttccatgtttggcatttgcatctcttgcttacttgtttgctgatttgaggcctctgctccttgataatcatcttttataagtctaacttggaagaaaaatgctgactggggaacttggccttgggaacttgtttctttttgttccttttccttttctttttccttctctttctctttttgttctgcttgctgtttttcttttctaaccacccttaagtgaacaattttagcattttctgcataagcatcatcgcggatagttacaactttgagatcatagtctttattatttttatggactatctcttggattttcttaaatggttcaagagactcaaacccttgactcgaaccagtctgacccatttgttggccattatttgttgttttaacttgatctcattcattttgttttagatagaaaattgaataagctgatgggatagataaaactaatttattcattaattcacgttcttgtttttctttaactccgatattagaacttgcaagataaagcttgataattgttttaggggtagtataaactactttcttagtagttttattataaattttataataataagttagtttatattcaactgcattctcaggtttgtttgtatcggtttcagaagaagatgaagaagaagaagatgaagatgaagaggatgaagaggatgaagactcagtgttattagcctctttctcaaattgtatttgatagtcaagatcttcgtcttggagttgacttcaacttgcaaaatttaatcttttagcctgataatagaaagctaaaagtagatcggctaaattatcaagttttgctgtattttccaagatgaattttttattttcttcagggatagatgagcccttctgttctgtacctgagctgctgccaccattattattttcggtccctaaatactttttagactctgtttcatattttttaactatagcctctatttgagatttaaggctagttaatttacttagaagatcttgctttgtagaagtggtcttagcatctgaagaatcacttgaatctgattttgaatcacttgaatcactactttgggttttaatatttagatctaaaggttgaattttattaagttcactaaaaatcttggtatcgcttatcccagcggataaaagattttgataatctgctaatttagtttttgcctcattaggtaaatataaagttgacatccatccacgttcgtggaattttaaaaactggttattaaaggaaaatccataaattccttggttattacttgatttatctataagtttaattgccttagctcgtctaaagatgccatcctcttcgatctgattaagatctaatttttcttcaggaccaattaaattattagctcttgcaatttcaaataaatattgaagaacttctcttggatctttctggactaaattagcataaaaagcaagaacatcataatcttcttttaggaatttattagattttaagttaacaagtttataatcttttgctaatctttgatctgatctaaactgggaaatatcttttagacttgggaaattttgttttccaactcaagcatctaaaagtgcctcgttagcacgaaaattatacttataagtaaactcggaactaattatttttttaatttcctcaaatctaggatttggcactcctatattttcatcgagatttttaggactagttggactaggacttgaacttggactagctggacttggactagttggactagggcttggactagttggactagaattagttgaatttgcgtcttgctgttggaactccgttgctttaacttgagaaacagatactgcttgacttgttggctgactagctaaattcttatccccatcaattagagcttctagttcttgttttgaaataaaagcagttagtgttgggagtttaacttctttaatttgttcggtttgtgtactagatccagaagaaccttgggtgctagttcctggtagttcactgagttgataaactagtttctgatttagatcgagttctttttgggtatgtcctactttttggtcttttgactcagatgtagtttccttttggaaataagggatgatgaaagtttctgtttttgattttagtaaaacattatctgaatcaccaaagaaacttgatcaaagactaattgttactggaatttcaatatggcttgtaattccatcttgagcatcccttatttttgcatttgcaatatcaaaagtatattcaatcccttgattattactaatgtatttctttagaacgccaagatcaattccaattttattagataaatattcagaattaattttttcttctagtttttgtgatttaagtttattagacctataaaatgttttattaaactctttaagaaagtctctggcacgttttgttctaattttaaatgatttagatggatcaggagttgccggtttttggactggagctttaggagagctttgaatttgagctttaggctgagtttgagcattaggctgcggctgagattgaggttgactctgaggttgaggttgttgttgttgttgtggattcgaactttgctgactaaccggaactaaaattctattttcttgcccttgatctaaattggatcaagctgacacacttgctttaacttgctttggttgcgaagaacttgtctgtggagctaccttaaagtcgctaagctgaagtttgcgcatggttattttgcttaaaattttatcaatttcggcaaaataagtttttttaatctcggtttgttcactttgaggtttttgtgacttttctggggcttgacctggttttagatcggtttcaagattaacaacaaattgatcaactggaactaatttaatctcttccagcatttctgcttcttcaatattaaggccacgaagttcaaatttagcctcatttgtgagtcttgcttttattaaaaaacttggttcagaattagcacttagactaataaaatcatttgtaccagcacgtcttgtaatactaaagtcaaaaattttaccttttttaaaaggtaaaacattattaggatcatcttttaattcatgaatatatctttgaaaatcagggaagtatttcgaaattcttgaaattgcctcttcttggtttccggatttgttaatatctgcggcaaaatcttcaacgcgggtaagaaaaggaattttttgtgatgctaatgaggtttgacttgaagaaaagtcgactgaaaaatcagtttcccgaagattttggatatttgtttgaaaacttttggtgatttttctatgatttgcattaaaatcagctaaggcaaactgggaacgttgagcataagcgatttttttacttaaaattgatgaatatgcggtataattattatctaattggtgttttgcccgaaattgaagggtaaatgtttgatttttatcatcaggaattaaattaataaactcaaaaaaaggtttatttggggcaaaactgacctcaaatttctgaatttttgaatttaccgctgtataaaaagagataaatttattaagatcaattccgggtcttaattttcctgtttcatcgaaaagtaatgcttttatttgtttatatgtagttgaattatcaaagacatcggatttaaaggcaacattatgaacttttgaaactaaactttcaagttcagcgcggggattttcacctttataacgaattcgcgttacaagcccaactgttgttgcaaatactgcaactccgacaatggctgttgctgttactaataatgaattcttattattcttagccatatttctccttatattattataatagacgaagtgatacaataattatactatagaagttaaaaattaaaaaaatttctcctaattatttttattttgaaaaataattttaaggtaaaaaaatgttctgaaatttcttgattggtttttattttaaattataacataacaaaataaaaaaacaagttttttcgttgagagtaaaaaaattattaatatttttaagctctagaccaaaaacaatagttgacaaccaaaagatttgccaaatttatctagaaatttcatttttaaactaataaacttaaaaaataacaaaaagttttttatttaatttttggtttaaccctcattatttattacttattattaatgttaacttatttcatatcatttattaaaaaattctattaaaaatttttgttataattattcttttgaaaaggatttaaaaaattccgagttataacacaaaaatttataattcaatattagaaatctcaaaaatttttgcttaaaatttaatcaaaaattttacctaggaggttcatatgcgttttaacaggctttttagtctagcaaaacttaaatttacaattatttttttagtaatctttataaaagaggcgggatttctaacccatatttttagctacaagtttatttttgagtatttttcagagaaaaaccctacttttaacctaaattggtccctaattttgttgctaatgccgcttgccatttttatcatttttacttttttgaaaggatgaatttttagttatttagaaatggaaatacgcaataaattaagcgatattataatcaaaaaaattcaaaaaagtaattattctgacctaaaatacaataaaaatgcaatgctttcctgatttaattatgatctcaaactcggtttgaatgcaattgaaaatcttttaaatattatttcaccgcttgtttctattatcactggaatttctttgatgatagttttatcaccgcaatgaggttgaattttaattgttactaccttaattctaagtttaattttactaatttttcaagggaaaattagtaatgctgcttcaaaaccagtgatgaaactatcaagtgatagtgaagctttttcaaactataacctcggtcttcttaactcttttaaatcatttttctttcataacaaaaatgaaaaatttaagcaacttttttataaaagttatgaaaatttatccaaagatcaaataaaacaatataagaaattaactaaattaaatgtaattctaactgtcttatttagtatttcgattgtgattgttttaactgaattagcttcgcagagggcaaaccaattatcattcttgatgaagctttttccaatcttgataagaaaaatctcgaaaatctagtgagttttttacttgatcagcaagttacactactatttatccttcataatttagatcaagagttagttgctaaatttgatttttgcttaaatttttcagaaaatcaaatttttcttcaacctgtaactgactaaattaaaaacttagaattaacgaaataacgtatttatgcagaaaacctgggtataaaattcaggtcttttatatttttgccaaaaaaacaaaaaacccccttgagagcgaaggaggtacgaaaaatctcaaggggcatatgaatgaatgcgttactactataaaaaaattttttgcagtcttttttttttttttttttttgtttgttttttgagggagcccaaaggtggccactacaactccctcaaaactgaatagtaattttttgtttttagattgaaatcgatttgttaaaatactttaagaatcaactttttaaactttgaatttattagtattagtcagctgaatgtattgctacacttacacctctaacctatcaacctcatggtctataaggaatttcataaggaatactcatctttgaggaagcttcccgcttagatgctttcagcggttatcttttccgtacttagctacccagctatgcctttggcaagacaactggaacaccagcggtacgtccactccggtcctctcgtactaagagcagctctcatcaatattccaacgcccacatcagatagggaccgaactgtctcacgacgttctgaacccagctcacgtaccgctttaattggcgaacagccaaacccttggaaccgacttcagctccaggatgcgatgagccgacatcgaggtgccaaaccttcccgtcgatgtgatctcttggggaagattagcctgttatccccggggtagcttttatccgttgagcgacggccattccacaatgaaccgccggatcactaagtcctgctttcgcacctgctcgacttgtaggtcttgcagtcaaccacacttttacctttatgctctgcatatggtttccgaccatattgagtgtagctttgaacacctccgttactctttaggaggcgaccgccccagtcaaactacccaccacgcactgtctctcttcctgttaagggaagcaggttagaaaatcaatttattaagggtggtatttcaaggttgactccacaaggactagcgcccttggatcgacatctcccacctatcctacacataataaaccaattctcaatacgaagttatagtaaagctccacggggtcttttcgtcttgatgcgggtaaccagcgttttcactggtaccataatttcaccgagtccaatgttgagacagtagggagatcattgcgcctttcgtgcaggtcaataattagttgacaaggaatttcgctaccttaggaccgttatagttacggccgccgttcacccgggcttcacttgaatgctttgccaataggctaacatctccgcttaaccttcgggcactgggcaggcttcaccctctatacttcggtttacacctttgcagagagctgtgtttttgataaacagttgccccccctattttactgaggccctttaagaaaaagggcatcccttcttgcgaacgtacgggataattttgcagagttccttaacattggttttctcgctcaccttagaatactcatcttggggacgtgtgtccgttcttggtacaggttgttattgaattagcgctagagacttttcttggaaacagagagtcatttaattcggtacttgagtctcctcttccctatgcatcacagcttgaaattaatgtcatacggatttgcctatataactttcttgactgcttaccccacaatccagtaagtggtaaaactatcttttttcgtaatcccatcactccaataacaagtatcggaatattaaccgattatccatcggatacgcttttcagcctctccttaggccctgactaaccctgggtggacgacccttgcccaggaaaccttccccaataggcgtcgaagattctcacttcgaatcgttactcattccggcattctcacttttaatttctccactagtggtcaccctctagcttcagcgaaattaaaacgctctcctaacgtaaacttaaaaagtttacccgcagcttcggtattatgttttagtcccgttacattattggcgcaagatctcttgactagtgagcaattacgcactctttaaatggtggctgcttctaagccaacatcctagttgtttaagaaatttcacaacctttctcacttaacataattttgggaccttagctgacgatctgggttgtttccctcgcgagcgcggacgttatcacccacgttccgactgcatagataagattaatggtattcggagtttgattatagtcagtacagctaggtgccgccattccacattcagtgctctacccccattaattagattctatacgctagccctaaagctatttcggagagaaccagctatctccaggttcgattggaatttcaccgctatccacaagtcatccgggcactttttagcgtactacggttcgaacctccactttgtgttaccaaagtttcattctgctcatggatagatcacctggtttcgggtctatgtcaacaaacttaacgccctatttagactcggtttccctacggctccgctttaatccgcttaaccttgcttgttaacataactcgccggaccatactgcaagatgtacgccatcacacattaacgtgctttgactacttgtaagtaaatggtttcagaatctatttcactcccctctcggggttcttttcacctttccctcacggtactagttcactatcggtgtctgattagtatttagccttaccaggtggtcctggcaaattcagacagggtttcacgtgccccgccctactcaggatacatctatgagattatataatttaatatacagggatatcaccttctatgtcaaagctttccaactttttctactattatataattttctaactcaattaaaatgtcctataaccccgtaaaaacggtttgggctcttcccatttcgctcgccactactttgggaatcattatttattttcttttcctgttgctactaagatgtttcaattcgcaacgtatctcgctgctttaattatgaattcattaaagcgcaatctaggtttgctagattgggttcccccattcggaaatctccgtatcatagtttatttccaactccacgaagcttatcgcaggtaatcacgtccttcatcgactttcagacccaaggcatccaccaaatactcttatttatttaaaaagttaaaactatttttgagtatagcctattttgagataatatatcttaaggtattttaacaattttagcataatctttctttttaattttttaattttcaaaaattaaaaagcaaaaataaactcggtttaatttttaaagatcattagaatattacctgatttttcaatcagaataaaattgttactattcagttttgaaagagctgttttgccttttggcaattttttttgttttgagagctttagagccctcaaaactaggtatatagtccaatttaaaattttacaacaactagattaataaataattataaataaataaggaggaaatgaattaaaaaaatacaaataaaatctataaaaatcttttaatttaataaaaagaataagaataaataatgaaaatgatgttaaaaatgtaaaaatttagaaaaaatttaatctaataaaaggtgtgaataaatttatgttttgtttttggtttttccgtagaaaggaggtgttccatccccacgttctcgtagggataccttgttacgacttcaccccagtcatcggtcctgccttaggcaatggtctccgaagttaactcaccgactttgggcattaccaactcccatggtgtgacgggcggtgtgtacaaaacccgagaacgtattcaccgcagtatagctgacctgcgattactagcgattccgacttcatgaagtcgagttgcagacttcaatccgaactgagactacttttttgagattagcttgacatcactgttttgctgctctttgtagtagccattgtagcacgtgtgttgccccactcgtaagaggcatgatgatttgacgtcgtccccaccttcctccggcttgcgccggcagtatctttagggttctcaactaaatgttagcaactaaagaaaagggttgcgctcgttgcaggacttaacctaacatctcacgacacgagctgacgacaaccatgcaccatctgtgatctcgttagcctcggctatatctctatagttttgcgagaatgtcaagagtgggtaaggttctacgcgtatcatcaaattaaaccacatgctccaccgcttgtgcgggttcccgtcaattcctttaagtttcactcttgcgagcatactactcaggcggatcatttaacgcgttagctgtgttagtgacttttgccaccaactaatgatcatcgtttacggcgtggactaccagggtatctaatcctgtttgctccccacgctttcgtcccttagtgtcaatatatgaccagttagctgccttcgcctattggtgttcttcctaatatctacgtattccaccactccactaggaattccgctaacctcttcataattctattttgccagtatctaaagcggactaaagttgagctttagcatttaactttaaacttaacaaaaaacctacggacgctttacgcccaataattccggataacgcttgcgacctatgtattaccgcggctgctggcacatagtttgccgtcgctttctaataaggtaccgtcaagactagagcatttcctatctagttttttcttcccttacaacagcagtttacatcccgaaagacttcatcctgcacgctgtgtcgctccatcaagctttcgcttattgtggaatattccttactgctgcctcccgtaggagtctgggccgtatctcaatcccagtgtggcggtacaacctcttggccccgctaaacatcatcgtcttggtaggcttttaccctaccaactaactaatgttgcgcacccccatttcttggtgaagcttgaaagctcctttgaataaaaattcatgcaaatttttatcatatccggtattagccactgtttccaatggttatcccagtccaaaaggtaggttaggtacgtgttactcacccatttgctactaaatattttagcgaactaaaatattccgttcaacatgcatgtattaagcacacagctagcgtttatcctgagccaggatcaaactctcatgattgcgtttaatttacaaattacaaattggattttttattatatacctagttttgaaagatctaaaattctactcaccgtttttttgcggtgtaaagataattgtaccataaaaatatttttttcttttcttttttttttttttttttttatcttcccactaactacaaaaacaaatggcaccaaaaacggcggcaattaatattatacaccatttgcgaaaaaaaagaaaaatttaagcttatattatataaataaaggattttgggggttttttggccaggaaaaatgaccaaaaaggtaaaaaattaagattttctctaaagaacagcgaaaaaaaatttcccttaatttctgaaattaattatgtttttctttaaaaaacattaaaataaatacttttttcttgtatttttcaattttaatgtttttttgtatttcctcaagaaaaacataattaaaattaggaaaattatgtattttttcctaattttttcttttttttcagaatttctaccaaaaaaagtataatttaataaaccgaggcaaacaagatgcagaactgaaaaataattttattggccacaggaatttccgctttgatcaccagttttgtctcgattttttgaacaagatacaggaaagaccaattaattaaaaaatatacttctgaatcagaaggcgaaaaaatagaaaaatttccaaatttaaaagaacaagttcttgaactcaaaagtgaaatttgactttttgaatctcttgaagttgttctttataaaataagcaaggaaaattatagaaaaaatcttttccttgaaaatgacggtttagtcgcttgtcttatccaaaaaaatatcgaaaatactgcaaatatagttgctgttgagtatttaaatcaagaaagatttgacaaaaaccttgaaaaattagcggttagtggccttaattttgctagtttttttgaacctttttttgattttatcctaatttcggttaaaattgaaataactgaaatattaaagtttttgaaaatgcttaaaactgacggaattttgatctgaaaataccagaaaaatcaacgacgaaaaattttaagatacttaaaatcgcaaaaaatcgtttttgatgaatatttttactacgattttttgctaattaagaaaaaataaattaaaatttaatgactaccaccaaaaaaaggagtataatatgaaaaacatagttgatgacaaaatcctcttgacccagcaaaaacttgaggaaattgaaaaagagcttgaacatttaatcaatgtcgagcgcgtgaatgtaatccaagaaatcaaagatgcccgttcacaaggtgatctttcagaaaatgccgaatatgatgttgctcgcgaaaaacagggtataattgaatcgcgaatccgtgaattggaaacaattatttccaaagcaaaaataattaaggccgatttagggtcaagcagagtttcaattggctcaaaagttagccttgaaaatgttgaaagtggcgagattcaaactttccaaattgtcagttcaatagatgctgatccttttaagagcaaaatttctaatttttcaccgattgcacaggctcttttaggacaacaccaaggtgatgaagttgaagttgatgtaaatgaaaaatattctgtaagaattttggaagtaattaacgaataatgcgtctttcagtccgtcaatttttccctgattcggctgaaaaatgaaaaaaatttgctaaaattgtaattccagttatatttgctacactttttatctcaataaataattttattgataattttatggtatcacaaataagcggaggaattactgccgtggggatagctaatgtctgaacagcaataattttttcctttattgtctcaattaattcgattggttcaattatttttagccaatattgggggaaaaaacaaagaaagctagccagacaagttaacaatatccggtatattttagcagtcacaaccgttttgatatttgcaattcttgcctggataatcccagatcaaatgctaagtgcggttcagcgaaataaaaatttgacaaatttggataaaaatatttttgaagaagcaaaaagttacctatttataatcgctttttcgtgaattttgtttgcctatattgtcacttcttcagcaattttgcgtgaaattgggataatgaaaattgcgcttttttttactttgctgaccctaatctcaaatgtaagcctaaatttagtgctaatcccgaaaatgggtgttgctggttcagctctggcaacggtaatttcccgttgtataagcgcaattttaatgactttttacatttttttctataaaaaagatatcagaataagcattttaaagctgttcaaaattgaaaaaaaaatttgaaaacagtattttcgccggtttttcgggatgaatttagtaattattacttcacttattatctcaatacgttcgattttatgagcacaaagtttaccgccgggatcaattggcagcgatgacgggactggtttttataaatattggggcatcgggtttctgacaatttccggaatagtaatgacaattgttaacattttactagcaacttttacatcaattcagaccagtgtctcaattgttgtcagccgcaatttaggtcaggataaaattgaaaaagcgcgaaaaaacgcggcaatgttgaaaggttttttatttattgtctcccttgcaatgtcaattttagcactaattgttgtaattattatcacaaaaactaacttaatcacaaagggattagaaattcaggtgcaaaaggggatggaaaattatttcactgaacacaatttagcaataaatctagaaattatccaaaaacagcagggtctggcaactaatttttatcttagtcaaattttttgaatctgccttttaatagtttttctaaacccaatttgagtccaagttaattcctcgcttaacataattcaggctggcggtcgcgcaaattttgccagtttatgtgacttttttatcggaatttcccagtttttatggcagcttcttgttgtttttgtatttttaccgttactaaaagatgtaaaaacaaaactgtttttttcaatgttgattttttatttttctgatatcataaagtggataatttatgaaattttatatctcaaaactaactgagcaataaatttaactctagaaaaaacggcgaaaaaaatactataatttctttacttttttttatttttagattataatttataataatattaataactaaaaatttcagataaaggagaaagttcatgcctagattaacaaatatgaaaatctcttttgtcgctatcttcatatcgattgcggtaattatgttaataattggggtaagattagctccttttgccatcttgcctaatttccgcctttcaattatcgggttgccgattaaaataaccgggtttatttttgggccaattgttggatttttaactggattactcgctgatttaatcacttttttgttcatcccgggggtttattcttgatattatacccttcatctttcgcttgctgggttcattcctggaatttttttctgattttttgtaattaaagggaagaaatgatttgagaaaaaaagtattttaactcgtttagaccagaaaatttttgaacaaaaacagaaaatttttgattttacatattatagaatcgctaacaaccaaaaagatgaaaatttagagcgaaaaatgaagcaaaaattactttttttacaaaaaaaagtaaagagagttgaaagttggcaagaagaaaaatcactgctgaatttttattgaattgccagtaatttaatcctgatttcaattgtagtaacaactatttatgttgttatgtttagctcttcaattgattttagtcagtctcgttttatttccagtaaactttcctttctaattttaacactttttgggacagtttcaatgataattttcctgcttttggcgagatttattaatttttttcgaaaaaatgaaagatatttaacaatcgcgccaattgttgttttttccgcgcttcatgaaccaatcgcaagcattattggggcaagaggagatgtccaatctggggcactaaacaattttgataccgcttttttaagccacatcatcgtttcacctgtaaaaatttgaattaatttatcagttatttattttacagcaaaagcggttgtaccacttgtttataaaaaattttcttattctatcacttaaaaaacggctaatatgactaatttacatcaggaaaaacgtaaaaaactgctttttcataatataaaaaataaatactgaaactattttagcctagaattagaggcaaatcaaggcagttttatatattcttcagataagaatttttttaatgaatttaaaaaaattcttgaagacgaaaatagttataatggttttattctcgaaaataatgaaccttatgaatatcagaaaaacacttgtttttcggattttttgacaaaaaaattttttgagaaaaataaaaataaacttgtaattgaagtacttttatcactttgaagaattgaaccttttaaaattaaaaccaatacaactagaagatacattcagtatttaagtataaaaaatgttgaaaattttttaaaaatgtttgaaaatgaactaaattatcttctcgaaaaccgggcacaagccttcaaatttattgaaaaaattgcaaaaatcaaagaagaataccaaattttaaacaaaaatttttataatttatacctaaaaacagagcttaaaccgaatattgaacaggaaaaattaaatgaaaaattaaaattaagcataccttatcccgaaactaagtttgagaatttaaaatttagccaaacatacgcacaaattgcgcttcaaactattaaaaatgatataaaaaatgtcataaatcatcataatagtctgataaattcatttgattctgacccttataaaatcaaaatttttattactggttataattgttttcttgatttaattaaaagaagtgataattttcgctgattaagttcattgcaaatttatgaaatttatttcaaatttgagcaatgactaataaaacttttaaatcagaaagctcttgaaaatattttaggtacccaaaattttttcaacaacacttttgcagaagaattttgggggttctgaaaacaaaacagccagcaaaaaattcttgaagaacgaaataaaaaagcccaaaaacactttaaagtcaagaaaataaactcttttcacaaggaaaatccctattatcaaaatttaaaaactaacagcaaaactctccttcgggcaaatattttatgacaacacgaagttataaaaatggaaaaaaagttgcgaaacaaaaattttcaaaactctttttttattaaaaggatttgagtttcttcaattgaaaacaaattaaaaaaattaaaagaaaaaatttcaaaagttgagtatgaaaatcattttattttcttaaaagatgcattaagtgatttaaaaaattttttctacttaaaaaatttaaaaaaaattgatgttttccttaaaaaaaatcaattttttattttttgttttgataacaaaataaattttgatatcctttataaaaaatatggagttctaactaatgatgacctattttttttagaaaccaaaaaaatgcaaatgggaaattattcgagatttttatttgatgaatattcatttttacttgagacaaattataaacaaaagctttttcagcactttttcaacaatggcgaaaattcagctcaactttttatttattcgcgcagaacaataaaaccaatcagggattttagtataattttcatcgaaaatggaactttagttgaatatattcgcgaaatcgatctgccactcacgccaaaaacatcttttggaaaatttttctatcagaatggtacttttgaacgcacaaatttaccgcttttagaaacacaattatacaaacaactccaaaacgaagtttttcaaaataattctggcggaattaaaaataattttgaatcttttataaattcctgaattccaataaaagaatttaaactcgaatttgatagtgagaataaaaaatattcgctaaaaaaagatattcttgtaattgatttataaaaggatttttatgaaaaataaatatgattttaaacttgtagaagaaaaaagaaatgaaaaatgacaaaaaaagggcttttttatcgccccaaaacaaacaaaaaagcctttttcaattatttctcctccgccaaatgtaaccggacaactccatcttgggcactcttgaaacgcttttatccaggattcattagtccgttaccacaaattacaaggttttgatgttctgcttctacccagtgtcgatcatgccggaattgccacgcaagtaaaagttgaagaggatttagcaaaaaaagggattaaaaaatctgatcttaaaagagaagaatttataaaaaaatgttatcactgaaaagaaaaacaatatttaaaaatcaaagagcaatgagataaactgggaatttgttatgatttttccaaggaaagattcaccctagatcaggatgctcaaattgctgtaagtgatttttttatcaaattatgagaaaaaaatctaatttatcgcgggcaaaaagcgataaattgagatataaaattacagactgcaatttctaatatcgaagtgatcaacaaacctgttgaacaaaaaatgtactatttaaagtactttttggaaaattctaatgaatttttaacagttgctactacccgaatcgaaacgatatcctctgatgttgccctggcaataaacccaaaagataaaagatatttgcacctggttggcaagaaagtagtccacccgctgacaaaaaagttaatcataattattgctgattcaaatgttagttccgattttggatctgggataatgaaagtttctgctcactcaattcttgactttgaaattatggaaaaacataatttagaatcaaaagattgcatcgataattatggtaatttaaatcacgaagtgccagaatttcaaggtcaaaatcgtttttttgcccgcgacttaattgcaaaaaaacttgaaaaagaaggatttttagctaaaatagaaactgttatttcaaatgttggtttttcccagcgcagtgatgaaattgttgaaattctaaaaaaaccacagtgatttgtaaaaatggatgaacttgctaaaagtttaatttcgcacttaaattcaaaagataaaattaaattctaccccaagaattttgaaaaaaacctgcgaaaatgatttgaaaaaattcatgactgaacgatttcacggcaactttgatggggccacagaattcctgtttgatgtaaaaatgacgaatttaaagtacaaattgactcacctggtcagggttgaattcaggatgaagatgttcttgatacttggttttcttccggaattagtgcttttgcttttcttggttgaccacagaatttcgatctaattaaatcatattttccgacaagtttactcgtgactggctgggatattttatttttttgggtagcgagaatgtatttttcatcactttttataatgaaacaaaagccttttgaaaaggttttgctccacggtttaatccgggatgaaattgggagaaaaatgtcaaaatctctcggaaatggcttagatccgatggaaataattgaaaaatatggctcagatacgctaaggcaggcattaattttcaattctagtcctggaaaagacatcaaattcaacattgaaaagttaaataccgcctgaaatttgaataataaaatctgaaacattgcaaaatatattgcagatttagacactttttttgcaaaacctgaccttattgacctttgaatggaaaataaaatttatattttaaagcggcaaatagtaaaaaatataaaaaaatataattttagcgtgattggaactgaaataaataattttatctacggggatttttcttcacgttatattgaattaattaaaactcgtaaaaacgggttttatgctcgcaaacttttgagaaaagttttaattattttacacccgtttttaccatttttaactgatttcttgatggaaaaaattttcaaaatggaaattttagaacaaaaaatgcctagaattagacagtttaaagaaaaccaaaaagttgaaaatatccttgaaattatagataatttgcgaacttatagagaaaaatttcaaatttctaaaaaaataattttagaatattgtataattaatgacaagttttctaatgctgaaatcgacatcataaacaaactcaccttcggaaaatggctagaaaataaagagttagtaattaaaacaaaaaattttgaaatcgcaattaaagttcctgaagaattgaaaaaagaacaaaaagggcgcgaattaaaagaaattcaatttcttaaatcagaaattttaagggctgaaaaaatccttacaaataaaggatttttagaaaaagctcctagagaaaaaatagatttagaacgaactaaacttgaaaaattaaaggaaaaattagttttttatgagaaaaagtaaagctttttattcagatttttcaattaaaattgaaaaatctgaatcaaatacttcttcttttccttcaaaaggaacaataaatgtttgagtataaaatctaacaaaaggatattcagaatttttatctttttgttcagtatttttttcaaaaaaatcatccggatttaaattttgtttatattcttttgctttataaataaaattcattacagaaatataggaatttagcttgttttttgcacttctttcttcatgcaaattatcattttttctgtgaagtttaaattttattatttttttagaagaatctaaactatcaaaaattaacttataatttggataggccttattatcttgaaatccaaaaacgttaatttcgcttgaattaggctcattgctttttttctctcggaatgcaaaagaatttatcatttgattgacatttatttgcagataattttttttatccgccgaaataattcctttttttaaaattttcacttcaacagatgaataaggaattaatgtacttggcaactttgttttttccctatcgattacagtttttttaccattaagttccaatgcagaaaagccaattgaggtaggaatcataaaaacatatcagaaatccttgaatttttcgtcaacgtgaggtatataaattgaatttgaatcctgatttaaacttttctttttttgttgtaattgccttgtattataatatcgatttatgaaattaaggtaggttatttctgtttttggactaaattttgtagtaaattctggcattaattctaaatttttcccaccatttacagccgaatttaaatcaaacaagaagaatttagcatctttatcttcatatattttctcattattttctggacttaattcaattaaattcggtgaatttactattttttttaattttttcgcattctcaataccagtttgactttctcttgaaatatttaacccgaaatgggttgaaccacaactaactaaaacaaaaaaagcgccacctaaaaaaacaaaactaggcaaaaaataatttaaattcttatatatttttaattttttcatagtcgaatttaaaaatatttaagcgttttgatcccttagtttctaaaaattccttaaccataacagaataagaatttgatctaaaaattatctttcttttctcgggtgaagtgaaatttcaaagcgaaaagagaaccttatctacaaaaatccggggattttcaagaatttttgtttcaatttggttaggtaaaaatcatttattgtttaaattttctgattctagcaaggaatttaacttctctgaaaagtgttttcaagataatcctgtatcacaaatttgatatttggtaatatgtgaatataaattatctctttctaaatatttaatctctcaattttcaagaaaatcagggtaaagatcaacaaagtccctatctaaattagaatttactgtaccaataattgtaagatttccggggataaaatttttttcctcaggatgagaaaatatatagaaagatagatcaaactgcgaaattccgagcaaactttcaccgttttctccgcgaataaaaagcggttttaaaggagctaatgtgatttttgcggcatcgttgtcgatattttcaagaattaagcaatattttttttctggatttcaataagccttgtgtaaaattcttgcaaaaggaccagggataaagtttaatttttccttagaacctaaaacaaaatcattataaccgataaaactttcagggttataatcatcaaaaaaagtcactatttcatagtttttttcgctgatctctgttttacataattcatttttaatcttagaataaattaaatttgccgaaggggaaattaagagcaagtttttcccactttttattattgtttttttaggctttaatataatttcgtgatttttcttatgaaaatctaatatattaaaaaaattttgcttaaaattagttttatttaacatgttttccaaggaaaagttaaataatttgttaattttatgaataaaataattatagtaatgttccttggaattaactgattttgaaattggatattttgaaatttccctttgcatttcctgttttgcttggtataataacggaagtgaaggaacttttttattagtattagaattatttttttcgcctttattaagataattgctgttgattttaacaaccttttcttgttttgaagaatctatatgttcaagattttctttttctaattggatgtgattacaacatttttcagctgcgcatatttcactttgtgcgttatcttgcagatttttttctccagatggttcagaaattttattaaaatctctttcaaattgatcttggtaaaaattactgtaaaaactgtttttttctatattgtcttcataagttttttcaatttctttttcaacaacattttgttctggacaacaattttgttctaaattattagaaattatgcgaatatcgctctgtttttcttgtattttttcttcaatttcaagtttttcaactgaatttgtggaagttaaatctgcattttcaagagaaatttggtgactttctgcttgatccttatcattaaaatttgcgggtaattctgataaatcaactttattttcttgactattttctaaaatagcttctaattcaatatcaactttttcggggttatttgaaattgtagttgaaatatcttgatttatttgtgtttcttgtaaggaattttctaaatttttctgcacttggttttctaaatgattaattgatgctttaaaatttatagtattatcatttttttcatcaagattatttgactctttttgcataagaacatcaacgatataatcgtaatttgcttgtgaattttgggttaaataatttgatcatttttcagaatctaacctaatcaaacttgctttttcaaaattataactttccagctgattattacatcttttaattaattcatcaatccttgaatatcagtgatcataaagttttattttaaaaaaattaatgttatattgttgattttttccccgagatgataaaacttcaaaaaaaactcctgaaattaaaatataaaaaatatgatctttttgttttaaattgtaacggagtaattttatgttaaattcagcgcaaactggttcgccaaaattaaaattttgaaatatttcatcaacagaaacaggagaattgttctgttttttaagcaattcaagcgtcattttaaaaatatgacgatattcataattgataaaactaactaaattaaacaaaattatgctgatatattctctaattttaataatcccactgtttactaatttggctaatatgttaattttttgttgtccaggagttaaaatatctgtttttgtcactcctaattgtgctgctaattttaagtgttcatttaaatcgccaattggttttcaatttttatttttataaatttttaatcatttatttttaaaattttgattaatttcttcgttatttaaaagaagtgcacggattaaaatttctaaactttcggcttttctaaggtgagtgtttgaaataagtgaccaaatacaaggtgtgattttgtttttcattatatttctccagattgatttttaaacgtttttaaactaataaaattttactaaatttcaagtaaaattttaaaaaaatggggataattttaattaaacccatttttttctttccagtcagggacgcattttttcacgataaaaatttgatttttgcaaataaaatatccccaatgtttgtaaaatttcccatattcccccaataattcaataaatttgaagggatgcctggaaaattaccccaaaaaatatgaaaataatggaaactatgcgctgagttttttgctgtttttttaaagtctcattttcctgcacattcattatccgattcgacttttttttgtttaaaatttttgggataatttgctgcaatgcctgcaccaaaaccgtaacaattattatgggtagataaattcaataaccttcaaaaagtttttgataggaggttgcagctaattccaaacctaaaaaataagtaactttaaaacttggaattccctgcaaagctcgccaaactgctataaaaatcggcattgtcaccaaaatttgtgaaaatggggaaaaaggggaaaagttattttttttatataaatcaacaatttcctgacggtgccgctgctgcatcaccttgtttttcttgtaattttcgtattttgcatcaatttttgcctttttaagttgcagttccatctgtttgttctggccaaaaattgttttaaatctaaaaataaatgaaataatttttgtaaatactacaactgctaaaattgataaaattgttatccaacccgaccattcgtacaatgactgcgaggcggtaactcaaaggataattttcgataacgggtaaacaaaaattgcataaaaagggcctaattttcaggattctgctcaggaaacaatcggaaaagctggaattttgttttgaaaagcaatattttttgctgcactttcatcgttattattccaactataagttttattttggatatcaatccgggaaaaattagttggaaaaacaagtttttttactaaattagcgtatccagaaagtattttttcagtttcaggggaaacatcttttcctgatttttgctcaaattctgcaattgctttttcaagttttccttgagaaaattgcggtaataaaattaatttgttataaattacctgaaaaacatcacgggcaaaaattgcatacgacctattaacgggcggaattttattatctaaattaaaaaaataactatcaattttctcgctaattgcagcattttctgaactagatttatcaaaactataagtatttatgggtaaacttttaacatctcgcagtttttcaaaatattgtttatcagatttaaggctaaaatattttggtgatggaattttaatctctgtccaatttgttttttgctctattgaattttctgaggaactaaaaaaaataaattcattatttttatccccctttaaatactcaaattcattttcgcctttttgaaacattatcagtgaactaaattcaccaaattcggcattttcgttttttatctgttttcttaaagcattgagaattttttcttgatttacttttttattatcagctgatactaaaaaattattattttttgtaactatatcaattccaggtaaatctttgttttttgattccctaaaaattgtgtaatttggagttatttcttcttttgaattataaaattcgagcgcttcaccgggattataagaagtttttacaaccatagactgaatacaaccagttagggaaattccaaaaataattgtatagaaaaaaatctttaagaacttaaaaaaacctttaaatttaaaggtttttttattttgattattttgactttggaaataatcaaaagctttaggtcggatttttctatttttcatttctctttaattctttaaaaattttagctaatttttggtatttggtttcaaagcttaggggtaaaaaattctttctcgcaattaaaactacacgaaaatttaaaaaaatctccccttttttccacaatatataaagcgcatttttaatttgtctcttatagtaattacgtttgactgcgtttgcaaacttttttggtactgaaatcccaatctcaaaaaaatcacttttcacataataaaatataagataattagtgacaatttgattttttttgttaattattgcttgaaattcccaattttttttaatactacgaattttttgcaaaactatctcaacaaaaattatttatcagaaacagttagtcttttccgaccttttgcgcgtcgtgcagcaagaatttttcgcccgtcggctgttgacattcgcgcgcggaatccgtgtgtttttaaatgttttcttttatttggttgataagttcgcttcat

The invention claimed is:

1. A method for identifying the presence of *Mycoplasma hyopneumoniae* bacterium strain ts-19 in a sample, the method comprising:

assaying the sample comprising *Mycoplasma hyopneumoniae* bacteria for the presence or absence of a nucleic acid molecule with a mutation selected from the group consisting of:

a GidA gene [tRNA uridine 5-carboxymethylaminomethyl modification enzyme] mutation, wherein an adenine at nucleotide 3075 of a *Mycoplasma hyopneumoniae* J strain sequence provided as SEQ ID NO: 5 is not present causing a frameshift mutation in a protein encoded by the nucleic acid molecule;

a mutation in a hypothetical protein, wherein an adenine at nucleotide 7324 of a *Mycoplasma hyopneumoniae* J strain sequence provided as SEQ ID NO: 5 is deleted causing a frameshift mutation in a protein encoded by the nucleic acid molecule;

a mutation in an intergenic sequence, wherein a thymine at nucleotide 17143 of a *Mycoplasma hyopneumoniae* J strain sequence provided as SEQ ID NO:5 is not present;

an isoleucyl tRNA synthetase mutation, wherein a thymine at nucleotide 31773 of a *Mycoplasma hyopneumoniae* J strain sequence provided as SEQ ID NO: 5 is not present causing a frameshift mutation in a protein encoded by the nucleic acid molecule;

a GTPase ObgE mutation, wherein an adenine at nucleotide 48566 of a *Mycoplasma hyopneumoniae* J strain sequence provided as SEQ ID NO: 5 is not present causing a frameshift mutation in a protein encoded by the nucleic acid molecule;

a mutation in an intergenic sequence, wherein an adenine at nucleotide 48881 of a *Mycoplasma hyopneumoniae* J strain sequence provided as SEQ ID NO:5 is not present;

a DNA polymerase IV mutation, wherein an adenine at nucleotide 51166 of a *Mycoplasma hyopneumoniae* J strain sequence provided as SEQ ID NO: 5 is not present causing a frameshift mutation in a protein encoded by the nucleic acid molecule;

a mutation in an intergenic sequence, wherein a thymine at nucleotide 59567 of a *Mycoplasma hyopneumoniae* J strain sequence provided as SEQ ID NO:5 is not present;

a mutation in an intergenic sequence, wherein an adenine at nucleotide 66347 of a *Mycoplasma hyopneumoniae* J strain sequence provided as SEQ ID NO:5 is not present;

a mutation in a hypothetical protein, wherein an adenine at nucleotide 75037 of a *Mycoplasma hyopneumoniae* J strain sequence provided as SEQ ID NO: 5 is deleted causing a frameshift mutation in a protein encoded by the nucleic acid molecule;

an exonuclease ABC subunit C mutation, wherein a thymine at nucleotide 79461 of a *Mycoplasma hyopneumoniae* J strain sequence provided as SEQ ID NO: 5 is not present causing a frameshift mutation in a protein encoded by the nucleic acid molecule;

a mutation in a hypothetical protein, wherein a thymine at nucleotide 86810 of a *Mycoplasma hyopneumoniae* J strain sequence provided as SEQ ID NO: 5 is deleted causing a frameshift mutation in a protein encoded by the nucleic acid molecule;

a mutation in an intergenic sequence, wherein an adenine at nucleotide 89715 of a *Mycoplasma hyopneumoniae* J strain sequence provided as SEQ ID NO:5 is not present;

a mutation in an intergenic sequence, wherein an adenine at nucleotide 94740 of a *Mycoplasma hyopneumoniae* J strain sequence provided as SEQ ID NO:5 is not present;

a mutation in an intergenic sequence, wherein a thymine at nucleotide 94742 of a *Mycoplasma hyopneumoniae* J strain sequence provided as SEQ ID NO:5 is not present;

a mutation in an intergenic sequence, wherein a thymine at nucleotide 104392 of a *Mycoplasma hyopneumoniae* J strain sequence provided as SEQ ID NO:5 is not present;

a mutation in an intergenic sequence, wherein an adenine at nucleotide 104393 of a *Mycoplasma hyopneumoniae* J strain sequence provided as SEQ ID NO:5 is not present;

a mutation in an intergenic sequence, wherein an adenine at nucleotide 117390 of a *Mycoplasma hyopneumoniae* J strain sequence provided as SEQ ID NO:5 is not present;

a mutation in a hypothetical protein, wherein an adenine at nucleotide 118681 of a *Mycoplasma hyopneumoniae* J strain sequence provided as SEQ ID NO: 5 is deleted causing a frameshift mutation in a protein encoded by the nucleic acid molecule;

a mutation in a hypothetical protein, wherein an adenine at nucleotide 118716 of a *Mycoplasma hyopneumoniae* J strain sequence provided as SEQ ID NO: 5 is deleted causing a frameshift mutation in a protein encoded by the nucleic acid molecule;

a mutation in an intergenic sequence, wherein an adenine at nucleotide 120943 of a *Mycoplasma hyopneumoniae* J strain sequence provided as SEQ ID NO: 5 is not present;

a putative outer membrane protein P95 mutation, wherein an adenine at nucleotide 125147 of a *Mycoplasma hyopneumoniae* J strain sequence provided as SEQ ID NO: 5 is not present causing a frameshift mutation in a protein encoded by the nucleic acid molecule;

a triosephosphate isomerase mutation, wherein an adenine at nucleotide 131715 of a *Mycoplasma hyopneumoniae* J strain sequence provided as SEQ ID NO: 5 is not present causing a frameshift mutation in a protein encoded by the nucleic acid molecule;

a mutation in an intergenic sequence, wherein a thymine at nucleotide 133772 of a *Mycoplasma hyopneumoniae* J strain sequence provided as SEQ ID NO:5 is not present;

a mutation in an intergenic sequence, wherein an adenine at nucleotide 147361 of a *Mycoplasma hyopneumoniae* J strain sequence provided as SEQ ID NO:5 is not present;

a mutation in an intergenic sequence, wherein a thymine at nucleotide 153557 of a *Mycoplasma hyopneumoniae* J strain sequence provided as SEQ ID NO:5 is not present;

a mutation in a hypothetical protein, wherein an adenine at nucleotide 155557 of a *Mycoplasma hyopneumoniae* J strain sequence provided as SEQ ID NO: 5 is deleted causing a frameshift mutation in a protein encoded by the nucleic acid molecule;

a mutation in a hypothetical protein, wherein an adenine at nucleotide 157051 of a *Mycoplasma hyopneumoniae* J strain sequence provided as SEQ ID NO: 5 is deleted causing a frameshift mutation in a protein encoded by the nucleic acid molecule;

a uracil-DNA glycosylase mutation, wherein an adenine at nucleotide 163824 of a *Mycoplasma hyopneumoniae* J strain sequence provided as SEQ ID NO: 5 is not present causing a frameshift mutation in a protein encoded by the nucleic acid molecule;

a mutation in an intergenic sequence, wherein a thymine at nucleotide 170370 of a *Mycoplasma hyopneumoniae* J strain sequence provided as SEQ ID NO:5 is not present;

a putative chromate transport protein mutation, wherein a thymine at nucleotide 178555 of a *Mycoplasma hyopneumoniae* J strain sequence provided as SEQ ID NO: 5 is not present causing a frameshift mutation in a protein encoded by the nucleic acid molecule;

a mutation in a hypothetical protein, wherein a thymine at nucleotide 183981 of a *Mycoplasma hyopneumoniae* J strain sequence provided as SEQ ID NO: 5 is deleted causing a frameshift mutation in a protein encoded by the nucleic acid molecule;

a mutation in an intergenic sequence, wherein an adenine at nucleotide 187424 of a *Mycoplasma hyopneumoniae* J strain sequence provided as SEQ ID NO:5 is not present;

a mutation in an intergenic sequence, wherein an adenine at nucleotide 187449 of a *Mycoplasma hyopneumoniae* J strain sequence provided as SEQ ID NO:5 is not present;

a putative ABC transporter ATP binding and permease protein mutation, wherein an adenine at nucleotide 190701 of a *Mycoplasma hyopneumoniae* J strain sequence provided as SEQ ID NO: 5 is not present causing a frameshift mutation in a protein encoded by the nucleic acid molecule;

a 50S ribosomal protein L3 mutation, wherein a thymine at nucleotide 212677 of a *Mycoplasma hyopneumoniae* J strain sequence provided as SEQ ID NO:5 is not present;

a mutation in a hypothetical protein, wherein an adenine at nucleotide 214047 of a *Mycoplasma hyopneumoniae* J strain sequence provided as SEQ ID NO: 5 is deleted causing a frameshift mutation in a protein encoded by the nucleic acid molecule;

a mutation in an intergenic sequence, wherein an adenine at nucleotide 214362 of a *Mycoplasma hyopneumoniae* J strain sequence provided as SEQ ID NO:5 is not present;

a mutation in a hypothetical protein, wherein a thymine at nucleotide 226284 of a *Mycoplasma hyopneumoniae* J strain sequence provided as SEQ ID NO: 5 is deleted causing a frameshift mutation in a protein encoded by the nucleic acid molecule;

a mutation in a hypothetical protein, wherein an adenine at nucleotide 234616 of a *Mycoplasma hyopneumoniae* J strain sequence provided as SEQ ID NO: 5 is deleted causing a frameshift mutation in a protein encoded by the nucleic acid molecule;

a mutation in an intergenic sequence, wherein a thymine at nucleotide 235499 of a *Mycoplasma hyopneumoniae* J strain sequence provided as SEQ ID NO:5 is not present;

a mutation in an intergenic sequence or a putative lipoprotein mutation, wherein an adenine at nucleotide 246806 of a *Mycoplasma hyopneumoniae* J strain sequence provided as SEQ ID NO: 5 is not present;

a putative lipoprotein (MHJ_0213) mutation, wherein an adenine at nucleotide 246808 of a *Mycoplasma hyopneumoniae* J strain sequence provided as SEQ ID NO: 5 is not present causing a frameshift mutation in a protein encoded by the nucleic acid molecule;

a ribonucleotide-disulphate reductase subunit alpha mutation, wherein a thymine at nucleotide 252401 of a *Mycoplasma hyopneumoniae* J strain sequence provided as SEQ ID NO: 5 is not present causing a frameshift mutation in a protein encoded by the nucleic acid molecule;

a mutation in a hypothetical protein, wherein a thymine at nucleotide 271614 of a *Mycoplasma hyopneumoniae* J strain sequence provided as SEQ ID NO: 5 is deleted causing a frameshift mutation in a protein encoded by the nucleic acid molecule;

a mutation in a hypothetical protein, wherein an adenine at nucleotide 293668 of a *Mycoplasma hyopneumoniae* J strain sequence provided as SEQ ID NO: 5 is deleted causing a frameshift mutation in a protein encoded by the nucleic acid molecule;

a thymidylate kinase mutation, wherein an adenine at nucleotide 300092 of a *Mycoplasma hyopneumoniae* J strain sequence provided as SEQ ID NO: 5 is not present causing a frameshift mutation in a protein encoded by the nucleic acid molecule;

a thymidylate kinase mutation, wherein an adenine at nucleotide 300098 of a *Mycoplasma hyopneumoniae* J strain sequence provided as SEQ ID NO: 5 is not present causing a frameshift mutation in a protein encoded by the nucleic acid molecule;

a DNA polymerase III subunit delta mutation, wherein an adenine at nucleotide 300772 of a *Mycoplasma hyopneumoniae* J strain sequence provided as SEQ ID NO: 5 is not present causing a frameshift mutation in a protein encoded by the nucleic acid molecule;

a DNA ligase mutation, wherein a thymine at nucleotide 305732 of a *Mycoplasma hyopneumoniae* J strain sequence provided as SEQ ID NO: 5 is not present causing a frameshift mutation in a protein encoded by the nucleic acid molecule;

a CDP-diacylglycerol-3-phosphate-3-phosphatidyl transferase mutation, wherein an adenine at nucleotide 328394 of a *Mycoplasma hyopneumoniae* J strain sequence provided as SEQ ID NO: 5 is not present causing a frameshift mutation in a protein encoded by the nucleic acid molecule;

a mutation in an intergenic sequence, wherein a thymine at nucleotide 410563 of a *Mycoplasma hyopneumoniae* J strain sequence provided as SEQ ID NO:5 is not present;

a mutation in a hypothetical protein, wherein a thymine at nucleotide 412710 of a *Mycoplasma hyopneumoniae* J strain sequence provided as SEQ ID NO: 5 is deleted causing a frameshift mutation in a protein encoded by the nucleic acid molecule;

a mutation in a hypothetical protein, wherein an adenine at nucleotide 413717 of a *Mycoplasma hyopneumoniae* J strain sequence provided as SEQ ID NO: 5 is deleted causing a frameshift mutation in a protein encoded by the nucleic acid molecule;

a mutation in an intergenic sequence, wherein an adenine at nucleotide 426313 of a *Mycoplasma hyopneumoniae* J strain sequence provided as SEQ ID NO:5 is not present;

a mutation in an intergenic sequence, wherein an adenine at nucleotide 431650 of a *Mycoplasma hyopneumoniae* J strain sequence provided as SEQ ID NO:5 is not present;

a mutation in an intergenic sequence, wherein a thymine at nucleotide 431669 of a *Mycoplasma hyopneumoniae* J strain sequence provided as SEQ ID NO:5 is not present;

a putative ABC transport system permease protein p69-like mutation, wherein a thymine at nucleotide 437234 of a *Mycoplasma hyopneumoniae* J strain sequence provided as SEQ ID NO: 5 is not present causing a frameshift mutation in a protein encoded by the nucleic acid molecule;

a putative lipoprotein (MHJ_0362) mutation, wherein an adenine at nucleotide 442618 of a *Mycoplasma hyopneumoniae* J strain sequence provided as SEQ ID NO: 5 is not present causing a frameshift mutation in a protein encoded by the nucleic acid molecule;

a putative ABC transporter permease protein mutation, wherein an adenine at nucleotide 465533 of a *Mycoplasma hyopneumoniae* J strain sequence provided as SEQ ID NO: 5 is not present causing a frameshift mutation in a protein encoded by the nucleic acid molecule;

a mutation in an intergenic sequence, wherein an adenine at nucleotide 491786 of a *Mycoplasma hyopneumoniae* J strain sequence provided as SEQ ID NO:5 is not present;

a mutation in an intergenic sequence, wherein a thymine at nucleotide 502594 of a *Mycoplasma hyopneumoniae* J strain sequence provided as SEQ ID NO:5 is not present;

a mutation in a hypothetical protein, wherein a thymine at nucleotide 512112 of a *Mycoplasma hyopneumoniae* J strain sequence provided as SEQ ID NO: 5 is deleted causing a frameshift mutation in a protein encoded by the nucleic acid molecule;

a transketolase mutation, wherein an adenine at nucleotide 519298 of a *Mycoplasma hyopneumoniae* J strain sequence provided as SEQ ID NO: 5 is not present causing a frameshift mutation in a protein encoded by the nucleic acid molecule;

a mutation in a hypothetical protein, wherein a thymine at nucleotide 534108 of a *Mycoplasma hyopneumoniae* J strain sequence provided as SEQ ID NO: 5 is deleted causing a frameshift mutation in a protein encoded by the nucleic acid molecule;

a mutation in an intergenic sequence, wherein an adenine at nucleotide 539244 of a *Mycoplasma hyopneumoniae* J strain sequence provided as SEQ ID NO:5 is not present;

a mutation in a hypothetical protein, wherein a thymine at nucleotide 558831 of a *Mycoplasma hyopneumoniae* J strain sequence provided as SEQ ID NO: 5 is deleted causing a frameshift mutation in a protein encoded by the nucleic acid molecule;

a mutation in an intergenic sequence, wherein a thymine at nucleotide 564250 of a *Mycoplasma hyopneumoniae* J strain sequence provided as SEQ ID NO:5 is not present;

a mutation in a hypothetical protein, wherein an adenine at nucleotide 569870 of a *Mycoplasma hyopneumoniae* J strain sequence provided as SEQ ID NO: 5 is deleted causing a frameshift mutation in a protein encoded by the nucleic acid molecule;

a mutation in an intergenic sequence, wherein a thymine at nucleotide 586142 of a *Mycoplasma hyopneumoniae* J strain sequence provided as SEQ ID NO:5 is not present;

a mutation in a hypothetical protein, wherein a thymine at nucleotide 591871 of a *Mycoplasma hyopneumoniae* J strain sequence provided as SEQ ID NO: 5 is deleted causing a frameshift mutation in a protein encoded by the nucleic acid molecule;

a mutation in a hypothetical protein, wherein a thymine at nucleotide 608132 of a *Mycoplasma hyopneumoniae* J strain sequence provided as SEQ ID NO: 5 is deleted causing a frameshift mutation in a protein encoded by the nucleic acid molecule;

a mutation in an intergenic sequence, wherein an adenine at nucleotide 613911 of a *Mycoplasma hyopneumoniae* J strain sequence provided as SEQ ID NO:5 is not present;

a mutation in a hypothetical protein, wherein a thymine at nucleotide 615804 of a *Mycoplasma hyopneumoniae* J strain sequence provided as SEQ ID NO: 5 is deleted causing a frameshift mutation in a protein encoded by the nucleic acid molecule;

a putative P216 surface protein mutation, wherein a TTG codon is inserted at nucleotides 625870-625872 of a *Mycoplasma hyopneumoniae* J strain sequence provided as SEQ ID NO: 5 inserting a glutamine into a protein encoded by the nucleic acid molecule;

a putative p216 surface protein mutation, wherein a thymine at nucleotide 628031 of a *Mycoplasma hyopneumoniae* J strain sequence provided as SEQ ID NO: 5 is not present causing a frameshift mutation in a protein encoded by the nucleic acid molecule;

a mutation in an intergenic sequence, wherein an adenine at nucleotide 634595 of a *Mycoplasma hyopneumoniae* J strain sequence provided as SEQ ID NO:5 is not present;

DNA gyrase subunit A mutation, wherein an adenine at nucleotide 683823 of a *Mycoplasma hyopneumoniae* J strain sequence provided as SEQ ID NO: 5 is not present causing a frameshift mutation in a protein encoded by the nucleic acid molecule;

a mutation in a hypothetical protein, wherein an adenine at nucleotide 699407 of a *Mycoplasma hyopneumoniae* J strain sequence provided as SEQ ID NO: 5 is deleted causing a frameshift mutation in a protein encoded by the nucleic acid molecule;

a mutation in a hypothetical protein, wherein a thymine at nucleotide 699923 of a *Mycoplasma hyopneumoniae* J strain sequence provided as SEQ ID NO: 5 is deleted causing a frameshift mutation in a protein encoded by the nucleic acid molecule;

a mutation in a hypothetical protein, wherein a thymine at nucleotide 737657 of a *Mycoplasma hyopneumoniae* J strain sequence provided as SEQ ID NO: 5 is deleted causing a frameshift mutation in a protein encoded by the nucleic acid molecule;

a mutation in an intergenic sequence, wherein an adenine at nucleotide 748454 of a *Mycoplasma hyopneumoniae* J strain sequence provided as SEQ ID NO:5 is not present;

a ribonuclease H11 mutation, wherein an adenine at nucleotide 768571 of a *Mycoplasma hyopneumoniae* J strain sequence provided as SEQ ID NO: 5 is not present causing a frameshift mutation in a protein encoded by the nucleic acid molecule;

an inorganic pyrophosphatase mutation, wherein an adenine at nucleotide 785221 of a *Mycoplasma hyopneumoniae* J strain sequence provided as SEQ ID NO: 5 is not present causing a frameshift mutation in a protein encoded by the nucleic acid molecule;

a mutation in an intergenic sequence, wherein an adenine at nucleotide 810058 of a *Mycoplasma hyopneumoniae* J strain sequence provided as SEQ ID NO:5 is not present;

a mutation in an intergenic sequence, wherein an adenine at nucleotide 810061 of a *Mycoplasma hyopneumoniae* J strain sequence provided as SEQ ID NO:5 is not present;

a putative ABC transporter ATP binding Pr1 mutation, wherein a thymine at nucleotide 817687 of a *Mycoplasma hyopneumoniae* J strain sequence provided as SEQ ID NO: 5 is not present causing a frameshift mutation in a protein encoded by the nucleic acid molecule;

a putative adhesion like protein P146 mutation, wherein a thymine at nucleotide 875082 of a *Mycoplasma hyopneumoniae* J strain sequence provided as SEQ ID NO: 5 is not present causing a frameshift mutation in a protein encoded by the nucleic acid molecule;

a mutation in an intergenic sequence, wherein a thymine at nucleotide 883049 of a *Mycoplasma hyopneumoniae* J strain sequence provided as SEQ ID NO:5 is not present;

a putative MgpA-like protein mutation, wherein a guanine at nucleotide 6060 of a *Mycoplasma hyopneumoniae* J strain sequence provided as SEQ ID NO: 5 is substituted by an adenine;

a mutation in a hypothetical protein, wherein a guanine at nucleotide 10909 of a *Mycoplasma hyopneumoniae* J strain sequence provided as SEQ ID NO: 5 is substituted by an adenine causing an alanine to threonine substitution in a protein encoded by the nucleic acid molecule;

a mutation in an intergenic sequence between an amino acid permease and NADH oxidase, wherein an adenine at nucleotide 96181 of a *Mycoplasma hyopneumoniae* J strain sequence provided as SEQ ID NO: 5 is substituted by a guanine;

a mutation in a hypothetical protein, wherein an adenine at nucleotide 118293 of a *Mycoplasma hyopneumoniae* J strain sequence provided as SEQ ID NO: 5 is substituted by a guanine causing an aspartate to glycine substitution in a protein encoded by the nucleic acid molecule;

a putative outer membrane protein P95 mutation, wherein a guanine at nucleotide 123175 of a *Mycoplasma hyopneumoniae* J strain sequence provided as SEQ ID NO: 5 is substituted by a thymine causing a valine to phenylalanine substitution in a protein encoded by the nucleic acid molecule;

a uracil-DNA glycolase mutation, wherein a guanine at nucleotide 163911 of a *Mycoplasma hyopneumoniae* J strain sequence provided as SEQ ID NO: 5 is substituted by an adenine causing a serine to phenylalanine substitution in a protein encoded by the nucleic acid molecule;

a mutation in a hypothetical protein, wherein a guanine at nucleotide 246307 of a *Mycoplasma hyopneumoniae* J strain sequence provided as SEQ ID NO: 5 is substituted by a thymine causing a glycine to cysteine substitution in a protein encoded by the nucleic acid molecule;

a myo-inositol catabolism protein mutation, wherein a guanine at nucleotide 259905 of a *Mycoplasma hyopneumoniae* J strain sequence provided as SEQ ID NO: 5 is substituted by an adenine;

a DNA tropoisomerase I mutation, wherein an adenine at nucleotide 330948 of a *Mycoplasma hyopneumoniae* J strain sequence provided as SEQ ID NO: 5 is substituted by a guanine;

a DNA tropoisomerase I mutation, wherein an adenine at nucleotide 330998 of a *Mycoplasma hyopneumoniae* J strain sequence provided as SEQ ID NO: 5 is substituted by a guanine causing a tyrosine to histidine substitution in a protein encoded by the nucleic acid molecule;

a mutation in an intergenic sequence between a putative ISMHp1 transposase and a hypothetical protein, wherein a cytosine at nucleotide 379103 of a *Mycoplasma hyopneumoniae* J strain sequence provided as SEQ ID NO: 5 is substituted by a guanine;

a putative transposase truncated pseudo mutation, wherein a guanine at nucleotide 411019 of a *Mycoplasma hyopneumoniae* J strain sequence provided as SEQ ID NO: 5 is substituted by an adenine;

a mutation in a hypothetical protein, wherein a guanine at nucleotide 438867 of a *Mycoplasma hyopneumoniae* J strain sequence provided as SEQ ID NO: 5 is substituted by an adenine causing a glycine to glutamine substitution in a protein encoded by the nucleic acid molecule;

a putative ABC transporter permease protein mutation, wherein a cytosine at nucleotide 446756 of a *Mycoplasma hyopneumoniae* J strain sequence provided as SEQ ID NO: 5 is substituted by a adenine causing a leucine to isoleucine substitution in a protein encoded by the nucleic acid molecule;

a nicotinate phosphoribosyltransferase mutation, wherein a guanine at nucleotide 495301 of a *Mycoplasma hyopneumoniae* J strain sequence provided as SEQ ID NO: 5 is substituted by a thymine causing a glycine to cysteine substitution in a protein encoded by the nucleic acid molecule;

a mutation in a hypothetical protein, wherein a guanine at nucleotide 538653 of a *Mycoplasma hyopneumoniae* J strain sequence provided as SEQ ID NO: 5 is substituted by an adenine causing an alanine to valine substitution in a protein encoded by the nucleic acid molecule;

a mutation in a hypothetical protein, wherein a cytosine at nucleotide 550628 of a *Mycoplasma hyopneumoniae* J strain sequence provided as SEQ ID NO: 5 is substituted by an adenine causing a glycine to valine substitution in a protein encoded by the nucleic acid molecule;

a mutation in a hypothetical protein, wherein a guanine at nucleotide 554103 of a *Mycoplasma hyopneumoniae* J strain sequence provided as SEQ ID NO: 5 is substituted by an adenine causing a proline to leucine substitution in a protein encoded by the nucleic acid molecule;

a mutation in a hypothetical protein, wherein a guanine at nucleotide 555585 of a *Mycoplasma hyopneumoniae* J strain sequence provided as SEQ ID NO: 5 is substituted by a thymine causing a threonine to asparagine substitution in a protein encoded by the nucleic acid molecule;

a mutation in a hypothetical protein, wherein a guanine at nucleotide 583967 of a *Mycoplasma hyopneumoniae* J strain sequence provided as SEQ ID NO: 5 is substituted by a thymosine causing a glycine to valine substitution in a protein encoded by the nucleic acid molecule;

a mutation in a hypothetical protein, wherein a cytosine at nucleotide 599805 of a *Mycoplasma hyopneumoniae* J strain sequence provided as SEQ ID NO: 5 is substituted by an adenine causing an aspartate to tyrosine substitution in a protein encoded by the nucleic acid molecule;

a mutation in a hypothetical protein, wherein a cytosine at nucleotide 615445 of a *Mycoplasma hyopneumoniae* J strain sequence provided as SEQ ID NO: 5 is substituted by an adenine causing a serine to isoleucine substitution in a protein encoded by the nucleic acid molecule;

a putative PTS system N-acetylglucosmamine-specific II ABC component mutation, wherein a guanine at nucleotide 743961 of a *Mycoplasma hyopneumoniae* J strain sequence provided as SEQ ID NO: 5 is substituted by an adenine causing an alanine to valine substitution in a protein encoded by the nucleic acid molecule;

a leucyl-tRNA synthetase mutation, wherein a cytosine at nucleotide 848512 of a *Mycoplasma hyopneumoniae* J strain sequence provided as SEQ ID NO: 5 is substituted by a guanine causing a methionine to isoleucine substitution in a protein encoded by the nucleic acid molecule; and a 16S ribosomal RNA MHJ_0709 mutation, wherein an adenine at nucleotide 881437 of a *Mycoplasma hyopneumoniae* J strain sequence provided as SEQ ID NO: 5 is substituted by a guanine;

or assaying the sample comprising *Mycoplasma hyopneumoniae* bacteria for the presence or absence of a protein encoded by the nucleic acid molecule with the mutation, wherein the presence of the nucleic acid molecule with the mutation or the presence of the protein encoded by the nucleic acid molecule with the mutation indicates that the sample comprises the *Mycoplasma hyopneumoniae* bacterium strain ts-19.

2. The method of claim 1, in which the assay is for a mutation selected from:

a mutation in a hypothetical protein, wherein a guanine at nucleotide 10909 of a *Mycoplasma hyopneumoniae* J strain sequence provided as SEQ ID NO: 5 is substituted by an adenine causing an alanine to threonine substitution in a protein encoded by the nucleic acid molecule;

a mutation in a hypothetical protein, wherein a guanine at nucleotide 246307 of a *Mycoplasma hyopneumoniae* J strain sequence provided as SEQ ID NO: 5 is substituted by a thymine causing a glycine to cysteine substitution in a protein encoded by the nucleic acid molecule;

a DNA tropoisomerase I mutation, wherein an adenine at nucleotide 330948 of a *Mycoplasma hyopneumoniae* J strain sequence provided as SEQ ID NO: 5 is substituted by a guanine;

a DNA tropoisomerase I mutation, wherein an adenine at nucleotide 330998 of a *Mycoplasma hyopneumoniae* J strain sequence provided as SEQ ID NO: 5 is substituted by a guanine causing a tyrosine to histidine substitution in a protein encoded by the nucleic acid molecule; or a 16S ribosomal RNA MHJ_0709 mutation, wherein an adenine at nucleotide 881437 of a *Mycoplasma hyopneumoniae* J strain sequence provided as SEQ ID NO:5 is substituted by a guanine.

3. The method of claim 1, in which the assay comprises high resolution melt analysis.

4. The method of claim 1, wherein the *Mycoplasma hyopneumoniae* bacterium is present in a sample from an animal, and wherein the absence of the mutation indicates that the animal is infected with virulent *Mycoplasma hyopneumoniae.*

5. The method of claim 1, wherein the presence of the mutation indicates that the sample is from an animal vaccinated with a vaccine comprising *Mycoplasma hyopneumoniae* bacterium strain ts-19.

* * * * *